United States Patent 12,577,609 (METHODS FOR CELL-TYPE SPECIFIC PROFILING TO IDENTIFY DRUG TARGETS) - sequence listing, part 3

SEQ ID NO: 1740 - DNA, 1626 bp, Homo sapiens
  ENST00000465155
attacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagtgagtgccttctagccttacccttcctctcgctcacgcctgtcttcaccagcttcatgtggctatcagaagaagagttagaaaaccccctacttggttatagtttcccaagaagggccttgtagctggtagcagaaatgccagttgcagaatgaggaggtggcaaagcagttaacacaatggatgtgacggtggatgtataaaaacaggtgtgtgaattcgtctgatgcctgactcccagcagcctcggccggttcatacatgtccatcagcttccaggctgcaggacatgccagcccagttaaagaggcttcacttgactgttttcctgagaaaaggaagctgccagctctcatttggctcactatgaaaagcctttaattaatctcttcaaacaagttatttccttaatccacaagcagtggttacacttgctttgcattcttgtctggttcctaactctagagcccttctccctggcttagccagtaagctgagcccctggctgcgttcagccggcccgcctgagagacactaggggaaatagcttttgtgggcaagcagggtggccggtggtgctcagcagtctttccagtggctgtgtccctcctccaaatgtggacaggccatgacagagtcttagcccaagtcccacagatccccaaaagttctgttgattgcttcaggggatcagtgaaaattagggaattttgtgtgttgctatatacattttttctggggagatgagcttctcattgagatctgtgactcagaatcgactaagccaccataagtctggatttctccccagctcccaaggcccttttgggtccagaagacctgcatatgggctgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgat

SEQ ID NO: 1741 - DNA, 2033 bp, Homo sapiens
  ENST00000341491
attacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaaca

SEQ ID NO: 1742 - DNA, 516 bp, Homo sapiens
  ENST00000366985
cgagcggagcctggagcaaaatgatgcttcaacacccaggccagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttataccc

SEQ ID NO: 1743 - DNA, 2103 bp, Homo sapiens
  ENST00000492118
ttaattccaaatcctgatgctgccccatattaattctgtgaattcgggcaaatgacttagtttgtctaaacctcaattatctcatctataaaaggcagctagatcttaactcactgggttctcgtgaggattaaatgagatagtgcccctaaggtttctggtatgaaggaggcactccttaaatgttcgagacttgccagagggcttcttctctgtctggactgtgctaatgaccacagatccccggttgagaggaatgcccagaccacactcatcctacactcatccctatactcattgtcccttgggaaccaactgcagggaggaggggaaatggccaccactggagggagtacacagcaggccaagacttatgggggactcttccaaattggggccatggaactgtcactatttctactctttattttccttttgtcatccttttgggttcaccgagctatagaataacagagggagatgaatttagcaaatacatcactgaagcttctccctcggaagttgggcccaagcaatgggaatgagaaaggtaaccttggaccgtgggggccatttgatttgatgaccccatccccacttcatttatcagttggccaatgaggcatggcgagtcaggcattgggccaggctctgggtaaagcaatggtggagactcaatgcttgcattggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaaca

SEQ ID NO: 1744 - DNA, 482 bp, Homo sapiens
  ENST00000336937
atgatgcttcaacacccaggccaggtctctgcctcggaagaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaactcccaaggcccttttgggtccagaagacctgcatatgggctgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccag

SEQ ID NO: 1745 - DNA, 767 bp, Homo sapiens
  ENST00000464547
atgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaactcccaaggcccttttgggtccagaagacctgcatatgggctgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaa

SEQ ID NO: 1746 - DNA, 858 bp, Homo sapiens
  ENST00000366983
atgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaactcccaaggcccttttgggtccagaagacctgcatatgggctgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggtacacccctgcatccaggcagcagcccaggccaccccctcctcactggcccttggctcctttcttgatgcctctgttgcttgtcccccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaa

SEQ ID NO: 1747 - DNA, 581 bp, Homo sapiens
  ENST00000613104
cacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggacca

SEQ ID NO: 1748 - DNA, 1917 bp, Homo sapiens
  ENST00000366987
ggcggaggtggggttagcttcagttgaccaaccatgccttgaggataaattggatgggatcagatgggaagatgtgacaagaagagaaatcctcctctatataggatgctctgctgtttcctaaggattttcagcaccttgccccaaaatcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggt

SEQ ID NO: 1749 - DNA, 2031 bp, Homo sapiens
  ENST00000613954
tccgctccgttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggt

SEQ ID NO: 1750 - DNA, 2620 bp, Homo sapiens
  ENST00000427136
aaccgtctcctggttgtggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 1751 - DNA, 2624 bp, Homo sapiens
  ENST00000439240
ggcgggccttgggaaccgtctcctggttgtggggtgggggggaaagatggcggagctgatgctgctcagcgagattgctgacccgacgcgtttcttcaccgacaacctgcttagcccggaggactgggacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 1752 - DNA, 425 bp, Homo sapiens
  ENST00000417614
ccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagtccttagatacttctccttccagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccg

SEQ ID NO: 1753 - DNA, 561 bp, Homo sapiens
  ENST00000477445
gggtgtggacacaaggaccccacccagcgcacagccctctgacctctgctcacttgccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaagtaagaccagtctgtccctgggagaccaacaggaatacagcctccttggaatgattcccctttttcttgtctccttctttgtaccttagaacagcgagctcaagttagggtctggaaacaggaaggtggtctgcatcatggtcttccttctcttcattgccttcaactttggacctgtc

SEQ ID NO: 1754 - DNA, 819 bp, Homo sapiens
  ENST00000465605
taattaattaattaaaaaaaaaaggccaggcacagtggctcacgcctgtaatcccagcactttggcaggccaaggcaggcggatcacaaggtcaggagatcgagaccatcctgactaacacagtgaaaccccgtctctactaaaaatacaaaaaaattagccaggcgtggtggcgtgcgtctgtagttccagctgctggggaggctgaggcaggagaatggcgtgaacccgggaggcggagcttgcagtgagccgagatcgcaccactgcactccagcctggtcgacagagcaagactgcatctcaaaaaagaaaaaaaggagaaaaggaggcgggctgcattgaccctgtcagagagcttgcagccattgaggctgcccaatccttgggtgctcttgtgtgggtgtggacacaaggaccccacccagcgcacagccctctgacctctgctcacttgccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaag

SEQ ID NO: 1755 - DNA, 1176 bp, Homo sapiens
  ENST00000498564
gggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccaggtactgaagaaggagaaaagggccgggcatggtggctcacgccggtaatcccagcactttgggaggctgaggcgggcgaatcacctgaggtcagaagtttaagaccagcctggccaacgtggtgaaaccttgtctctactaaaaatacaaaaattagcgtggagtggtggcaggcgcctgtaatcccagctcctcgggaggctgaggcaggagaatcacttgaacccaggaggcggaggttgcagtgagccgagatcatgccactgcactccagcctgggcgacaaagcgagactttgtctcaaaaaaaaaaaaaagaaaaaagaaaaa

SEQ ID NO: 1756 - DNA, 1020 bp, Homo sapiens
  ENST00000477295
ctcagcatttcttgcagacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccaggtactgaagaaggagaaaagggccgggcatggtggctcacgccggtaatcccagcactttgggaggctgaggcgggcgaatcacctgaggtcagaagtttaagaccagcctggccaacgtggtgaaaccttgtctctactaaaaatacaaaaattagcgtggagtggtggcaggcgcctgtaatcccagctcctcgggaggctgaggcaggagaatcacttgaacccaggaggcggaggttgcagtgagccgagatcatgcc

SEQ ID NO: 1757 - DNA, 564 bp, Homo sapiens
  ENST00000475964
gggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcaggtaataaaacagcctgcccccaatccttggctctactacgggagaatgtgttatgtgtgtgtgtgtatgtgtgta

SEQ ID NO: 1758 - DNA, 320 bp, Homo sapiens
  ENST00000494022
cttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaaggcctcctgaatgatgccagcccagtatgctct

SEQ ID NO: 1759 - DNA, 2620 bp, Homo sapiens
  ENST00000375203
aaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 1760 - DNA, 2624 bp, Homo sapiens
  ENST00000375201
ggcgggccttgggaaccgtctcctggttggggggtgggggggaaagatggcggagctgatgctgctcagcgagattgctgacccgacgcgtttcttcaccgacaacctgcttagcccggaggactgggacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 1761 - DNA, 425 bp, Homo sapiens; identical to SEQ ID NO: 1752
  ENST00000453203

SEQ ID NO: 1762 - DNA, 561 bp, Homo sapiens; identical to SEQ ID NO: 1753
  ENST00000475705

SEQ ID NO: 1763 - DNA, 819 bp, Homo sapiens; identical to SEQ ID NO: 1754
  ENST00000492342

SEQ ID NO: 1764 - DNA, 1176 bp, Homo sapiens; identical to SEQ ID NO: 1755
  ENST00000495579

SEQ ID NO: 1765 - DNA, 1020 bp, Homo sapiens; identical to SEQ ID NO: 1756
  ENST00000485314

SEQ ID NO: 1766 - DNA, 564 bp, Homo sapiens; identical to SEQ ID NO: 1757
  ENST00000468502

SEQ ID NO: 1767 - DNA, 2620 bp, Homo sapiens
  ENST00000425571
aaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtcgccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtggaacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 1768 - DNA, 2624 bp, Homo sapiens
  ENST00000435768
ggcgggccttgggaaccgtctcctggttggggggtgggggggaaagatggcggagctgatgctgctcagcgagattgctgacccgacgcgtttcttcaccgacaacctgcttagcccggaggactgggacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtcgccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtggaacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 1769 - DNA, 425 bp, Homo sapiens; identical to SEQ ID NO: 1752
  ENST00000436157

SEQ ID NO: 1770 - DNA, 561 bp, Homo sapiens; identical to SEQ ID NO: 1753
  ENST00000462947

SEQ ID NO: 1771 - DNA, 819 bp, Homo sapiens; identical to SEQ ID NO: 1754
  ENST00000461317

SEQ ID NO: 1772 - DNA, 1176 bp, Homo sapiens
  ENST00000492011
gggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtcgccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccaggtactgaagaaggagaaaagggccgggcatggtggctcacgccggtaatcccagcactttgggaggctgaggcgggcgaatcacctgaggtcagaagtttaagaccagcctggccaacgtggtgaaaccttgtctctactaaaaatacaaaaattagcgtggagtggtggcaggcgcctgtaatcccagctcctcgggaggctgaggcaggagaatcacttgaacccaggaggcggaggttgcagtgagccgagatcatgccactgcactccagcctgggcgacaaagcgagactttgtctcaaaaaaaaaaaaaagaaaaaagaaaaa

SEQ ID NO: 1773 - DNA, 1020 bp, Homo sapiens
  ENST00000483144
ctcagcatttcttgcagacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtcgccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccaggtactgaagaaggagaaaagggccgggcatggtggctcacgccggtaatcccagcactttgggaggctgaggcgggcgaatcacctgaggtcagaagtttaagaccagcctggccaacgtggtgaaaccttgtctctactaaaaatacaaaaattagcgtggagtggtggcaggcgcctgtaatcccagctcctcgggaggctgaggcaggagaatcacttgaacccaggaggcggaggttgcagtgagccgagatcatgcc

SEQ ID NO: 1774 - DNA, 564 bp, Homo sapiens; identical to SEQ ID NO: 1757
  ENST00000476416

SEQ ID NO: 1775 - DNA, 2620 bp, Homo sapiens
  ENST00000293709
aaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcccggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 1776 - DNA, 2624 bp, Homo sapiens
  ENST00000383156
ggcgggccttgggaaccgtctcctggttggggggtgggggggaaagatggcggagctgatgctgctcagcgagattgctgacccgacgcgtttcttcaccgacaacctgcttagcccggaggactgggacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcccggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaggaa

SEQ ID NO: 1777 - DNA, 425 bp, Homo sapiens; identical to SEQ ID NO: 1752
  ENST00000413319

SEQ ID NO: 1778 - DNA, 561 bp, Homo sapiens; identical to SEQ ID NO: 1753
  ENST00000465333

SEQ ID NO: 1779 - DNA, 819 bp, Homo sapiens; identical to SEQ ID NO: 1754
  ENST00000491968

SEQ ID NO: 1780 - DNA, 1176 bp, Homo sapiens; identical to SEQ ID NO: 1755
  ENST00000463669

SEQ ID NO: 1781 - DNA, 1020 bp, Homo sapiens; identical to SEQ ID NO: 1756
  ENST00000465377

SEQ ID NO: 1782 - DNA, 564 bp, Homo sapiens; identical to SEQ ID NO: 1757
  ENST00000467437

SEQ ID NO: 1783 - DNA, 2868 bp, Homo sapiens
  ENST00000378954
agatggcggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatggcaaaatctggtcctgtggtaggctaaataagtactgtccctgtgaaaggaatgtttgtggctcatgtcagtgtgtgaatgcatagacaatttgaagtttttgatatatttgtgatatttatcttgagcactgcaatctcaccccccccccgcccaccaagggaattcaatgggaatgtttattgtgactttgtcctctgttgcattttaaagttatttcctgtaatttattttcagtacataattaaaaatttgttgtatatataaaatgaaa

SEQ ID NO: 1784 - DNA, 2864 bp, Homo sapiens
  ENST00000406122
ggagttaattttaaatcggtacaagatggcggagggggacgaggcagcgcgagggcagcaaccgcaccaggggctgtggcgccggcgacggaccagcgacccaagcgccgcggttaaccacgtctcgtccacgacctccctaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacagaggagtcccaggaaggtgttttccaaactgtttgaagttactagacgtcgaatggttcaccgtgctctttcatcagcacagcgacagagactgtcatccaacaataacaagaagaaaaattagacagtatttttaacctttttctctatctgaagtgttcacacttacacatgtaggacaataagcaggaccgtctgggccggtctgcataaatgctgtatacataccagatttgatgctgcatatagggtatggaattgcacatccatctcataggaattgtaaatggtttgaataagaggaaagtaatttttgttgcattataaaatgtctagtagcatcataagtttttttgagagaagcatctttttatttcccatattcctggttattttcatcattgctttgaattgaatttttatatctatttttatatgtaactctttttttacctcatgtttttgtttgttttgcacatttctcataccacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatg

SEQ ID NO: 1785 - DNA, 1883 bp, Homo sapiens
  ENST00000402054
actgtggtgcgaattgatcgcatgaaatcctgattgaaaattttgatggtacttaagaaaggcataaagttttttcaaaggcttataaatagtaaaagcctacgatttggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatt

SEQ ID NO: 1786 - DNA, 1905 bp, Homo sapiens
  ENST00000405384
aaatcggtacaagatggcggagggggacgaggcagcgcgagggcagcaaccgcaccaggggctgtggcgccggcgacggaccagcgacccaagcgccgcggttaaccacgtctcgtccacgacctccctaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatt

SEQ ID NO: 1787 - DNA, 2335 bp, Homo sapiens
  ENST00000419554
aaatcggtacaagatggcggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtgttttccaaactgtttgaagttactagacgtcgaatggttcaccgtgctctttcatcagcacagcgacagagactgtcatccaacaataacaagaagaaaaattagacagtatttttaacctttttctctatctgaagtgttcacacttacacatgtaggacaataagcaggaccgtctgggccggtctgcataaatgctgtatacataccagatttgatgctgcatatagggtatggaattgcacatccatctcataggaattgtaaatggtttgaataagaggaaagtaatttttgttgcattataaaatgtctagtagcatcataagtttttttgagagaagcatctttttatttcccatattcctggttattttcatcattgctttgaattgaatttttatatctatttttatatgtaactctttttttacctcatgtttttgtttgttttgcacatttctcataccacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaa

SEQ ID NO: 1788 - DNA, 2199 bp, Homo sapiens
  ENST00000452935
cttcctggagggaaccgcagtccgcaggccagggctctgtccccgggctcgcgtttcggggctcctcggctcccgaacccattcgcgcgggttgtgcgtggctagggtgcaagtctagattttcgtgtcaaactggggttatgagccgtttacgagtcacttggacgatagtaaggcctgatcactctgaaagtgtctgtagtgtgaagtcacctgatccttggctccctggttttgctgaatgtgagctcctactgtacgtgtaccaggagcgcccctgccccctcgaagacgcagttgcgttggcagcgcagtgtatccctctcactcataacacccctatttataggagtttagcgtttgatctctcactgtggtgcgaattgatcgcatgaaatcctgattgaaaattttgatggtacttaagaaaggcataaagttttttcaaaggcttataaatagtaaaagcctacgatttggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagttta

SEQ ID NO: 1789 - DNA, 764 bp, Homo sapiens
  ENST00000477642
aaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggttggtatctatcttttggttttttagtgactaatcttattttcctgtgactttccatcctttgcagtatttgtactccgactttgccttcatgtgaggaatgtcaaaaggatgtcttctgttttgttcagatgtagaatctttatgaattgaagattttttctttaaagttataattttaatgtactttggttagcctaaatctgtactatc

SEQ ID NO: 1790 - DNA, 592 bp, Homo sapiens
  ENST00000489896
ttttaatggtgttaattatttttatatttaatgacttttctttctttggggatgtggagccaaattgcataatccgtcagtctaacaaatcttctccctttttaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcat

SEQ ID NO: 1791 - DNA, 526 bp, Homo sapiens
  ENST00000449130
gatggcggagggggacgaggcagcgcgagggcagcaaccgcaccaggggctgtggcgccggcgacggaccagcgacccaagcgccgcggttaaccacgtctcgtccacgacctccctagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaag

SEQ ID NO: 1792 - DNA, 775 bp, Homo sapiens
  ENST00000443098
cggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaa

SEQ ID NO: 1793 - DNA, 578 bp, Homo sapiens
  ENST00000456736
agatggcggagggggacgaggcagcgcgagggcagcaaccgcaccaggggctgtggcgccggcgacggaccagcgacccaagcgccgcggttaaccacgtctcgtccacgacctccctagagtcttgctctgtcgccaggttggagtgcagtggcacgatcttcgcttactgcaacctcccgggttcaagtgattcctctgcctcagcctcccaagtagctgggattacaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttca

SEQ ID NO: 1794 - DNA, 597 bp, Homo sapiens
  ENST00000474535
ctttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtgagacacaagattaagtggtgcgatcagttcacgtaatcatttggccccttttttttttcttttttgagacagagtttcactcttgttgcccaggctggagtacagtggcgtgatctcggctcactgcaacctctgcctcctgggttcattctcctaacccgagtagctgagattacaggcccccgccaccatgcccagctaatttt

SEQ ID NO: 1795 - DNA, 561 bp, Homo sapiens
  ENST00000472097
aaatcggtacaagatggcggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagtaaaattctgtttatacttttctaccctgtattctttcttgggctattt

SEQ ID NO: 1796 - DNA, 576 bp, Homo sapiens
  ENST00000451483
aattttaaatcggtacaagatggcggagggggacgaggcagcgcgagggcagcaaccgcaccaggggctgtggcgccggcgacggaccagcgacccaagcgccgcggttaaccacgtctcgtccacgacctccctagagtcttgctctgtcgccaggttggagtgcagtggcacgatcttcgcttactgcaacctcccgggttcaagtgattcctctgcctcagcctcccaagtagctgggattacaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacagg

SEQ ID NO: 1797 - DNA, 553 bp, Homo sapiens
  ENST00000486927
atttcaagtggaaaatagtatgtgaatcctataggaaaaacaactctttgtttcctgatttaatagtaatgaaggaaggagatgaatgacggagtctcgctctgtcgcccaggctggggtgcagtggcacggtctcggctcactgcaagctccgcctcttgggtccacgccattctccggcctcagcctcctgagtatctgggactacaggcgcctgccaccgtgtccggcttactttttttgtatttttaatagagacggggtttccctgtggtctcgatctcctgacctcgtgatccgcccgccttggcctcccaaagtgctgggattacaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggact

SEQ ID NO: 1798 - DNA, 593 bp, Homo sapiens
  ENST00000416222
aaatcggtacaagatggcggagggggacgaggcagcgcgagggcagcaaccgcaccaggggctgtggcgccggcgacggaccagcgacccaagcgccgcggttaaccacgtctcgtccacgacctccctagacggagtctcgctctgtcgcccaggctggggtgcagtggcacggtctcggctcactgcaagctccgcctcttgggtccacgccattctccggcctcagcctcctgagtatctgggactacaggcgcctgccaccgtgtccggcttactttttttgtatttttaatagagacggggtttccctgtggtctcgatctcctgacctcgtgatccgcccgccttggcctcccaaagtgctgggattacaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactgg

SEQ ID NO: 1799 - DNA, 1242 bp, Homo sapiens
  ENST00000629272
atggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacagaggagtcccaggaaggtgttttccaaactgtttgaagttactagacgtcgaatggttcaccgtgctctttcatcagcacagcgacagagactgtcatccaacaataacaagaagaaaaattag

SEQ ID NO: 1800 - DNA, 7135 bp, Homo sapiens
  ENST00000398868
acacgcggcaggcggtggcgggattctgccgcgtgcgctttcccgccccgcctcgcctagcctcgtcctgcgctcgccacgcctcgggctgtccgttgggccacgcagaccgcgctgcgctcgctccgtcgcggctccgcgtgccccaccttctggctagttttttctagagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttggaagcatttcttttccttgctgttatagatgcaagcctgtgtctattttcatattactctgctttgtgcactttatggaggaggaagctagaggaaaaatggaaatgcagcttttaagttctttatgtgccacttagtgccttttaagattgattccatggttttgcacacacgatggggaggggatggaggataacctcatgaaaggtgccgttttcgggtgaaacttgacatttcttttatactttactcttttgagaaggattctttttttttttttttttttttttgagttggagtctcgctctgtcaccaggcttgagtgcagtggtgtgatcttggctcactgcaacctctgcctgccgggttcaagcagttctcctgcctcagcctcccaagtagctgggactacaggtgtacgccaccatacccagctaatttttttgtatttttagtagagatggggtttcaccatgttggccaggatggtcttggtctcttgaccttgtgatccgcctgcccgccttggcctcccaaagtgctgggattacaggcgtgagccaccgtgcccggccaagaaggattccttttttaaaagtttacagaacttggagaaacttcagaactaaagactaactgaaaatgatgtcattacactcaaaaaaaatttacaatagggaatcctgttgccacatagtgtggaaaaatcatgtcatatttaaatataccatactctgaaatgtgaggtttttacccagtaggctgacagttttgttgcaacttgctctattttttttttttttttggtccctatagcttctttctagaaaaagaggcaaacgtgccttgaaaagccagagtggctcataataaaaggaatgcgctagatacttcaagaaaaaagctaagtttaaatgaaccatgtgacctctgataagtcacttgaacttgtgccttggtcaggttcactgtaggtttacatatgtatgtatgttttacacaactcttgtaattgtcatttgaggggttttgtttttgagagttctgcataagaacagaactttattaaggattagagggaagatacaaatattactgcgtttaattgatgtctaatttcatgtggcttagcagcaattaataacctgatttaaggtctttattcagaatgttaatttgcattctctgccgtgtctaatgttcttaataatgaagctaaaattaacccattttatttagtgaattatctatttaattttactttggctagtctggtagctttaagatagctttgccttagcaaggatcaaagtcctacccaaatataaaaaatatctagaagtatctaagagttctttttttctatttaccttgattaggagataaaagttttatctgttagttgcttttccttttggaattattgtggattttaaaacttaaaacttgcctgcaagtatttatataaacattcaggtatataagccttaatttctaagataatttaacttttgttatgggagggaggtaagagtgtaaattttatatacatgaaggtaagatctgagtgtaaactttacatacatgaagtatgaatggaaggtagaaaaaaagtcccttttcgcatgtaatctctttatcaaagaattttcttttgacactttaccactgaagtatttttgtaagtcctaaattcgcagcatattgtttcatatttatatgccatcttgcaaatagttcttgctattttattcactgctgttacactttagaaaaattccagcttgtttacttgcatttatcagtgatgccaaccaagctttgactgttaacttgaaagcttgcttctgaaatgttggtgcattttcaggtgacctcttatctctctgaaagttcatacctattagcaggctctgtaaatattgacatacttagcttttaatacattctataagtaaatttatagatttcagaataacttaaaaaatttaatggtaagaaggggtgatgtgtcgaaaactcatactaaagtattaggtcactttaaaaaaagtgataatgtatgatttaatgaaatcttaagattcagttactatttaaattcaccatttctgttttggtcttataaagagaccttggtttaattatccagaggaagtcctcttcaccattttttttttttcttagttctgcttctggaaagtgttttataaagttttctcagtgagggttcttaagagttttctttggcctcttttctctcaacagtaaattgatgattttatatcagctttttcaataaaagatgcattatcattactggctataaatcatcctggggagatttataaccaggttaaaaataatatcttttacttctctcaccttttacttgtggttcagatgctcagactgtgcctgtttgcgtcgtgtctgttgctctgccgctttccatgcaggcatttttaattttacacaatcctaacaatatatggaactcattcctatgaatatataaaaggaggcttccaaaattttctattaaaatatttcaggataaattaagtgttgataatttgaaaaaataatttcaatgagctgcttatagtaaaaatggtagaatcagagttttcattctttgagaaatctttctgtaagattggctcatagataaaatgagacaaactactatgtatgataaaacaccttcagagtcatgccttgttttattttattttattttttgagacagaggtctcgctctgtcgcccaggttggagtgcagtggtgcaatctcgctcactgcaacctccacctcccaggttcaagcgattctcctgtctcagcttcctgagtagctgggactacaggtgtacaccaccacgcctggctaatttttgtttttttactagaggtggggttttgccatgttggccaggctggtctcaaactcctgacctcaggtgatccactccccccagcctcccaaagtgctgggattacaggcatgagccaccccgcccagctgagtcatgccttattttcgtagtataccaagaaatgttctatggaagtttacgttttaacacctcttttatacttggtaaaattgcctgtgtttcgctttattcctttttttttttgagacggactcttgtactgtcacccaggctgaagtgcagtggcgcaatcttggctcactacaacctccgcctcctgggttcaagtgattcttttgcctcagcctcccaagtagcagggattacaggcatgtgccaccacacccggcttatttttgtatttttagtagagacagggcttcgccatgttgaccaggctggtctcaactcctctgggaatccgcctgtcttggccttccagggtgctgggattacaggcgtgagccactggaacctggccttgttttgctttattttttctcttacatgaagtaaagcgctttggtcaaacacacaaaaatactgccttgtactggtggttggtttcattagtggatcacacacagtgttctacttggcttgtaaaatggtgccttggatagggtgagtttggataagtatgtatgtatgtatgagttatagcaaaattaagtagattgaatcaagtccatgcaaaagcaataaaacagttttaattttttaattttttaaaaattaaaactttaataaaacagtttttaattttttgctaggttcttttaaaaaatgatgtaacttacatggaagtcttcacaggacttttttctttcctggaactattgaaatgtaatttaggatgatttgatcttccatctcaagttgtcaacatggctgtgtcattctggcttacatatgttttatttaacaaaattctagtcaagggataagggcataatgaagacaagcttcagttatgaaagtacaaactatttgtgtgattaatttttaaaaatgacattaagaagcccattgtaaaataatatttgcagtcaaatggtttttcttgctgtaagtcctgttgtagctatgtttagggtagtggttctcatctaccttggagtgcataagacttacctagcaggcttgtttaaaaagttcagattcctagctttgtacccagggattgcctcaggtggtatgggctgtggtcctggagtcatcacttttataaatagtggttcagagaccacagagagagactgcttcatcgaatgggaagtaccaaggagaaagtacaattcagtattgtctggaggcaagtggacactttgtacctgaggtttagaataggtggtctcttgccagtacaatccccaggcgttttctgtgttcagaagtagtaagaatgcctttaattcagaggattatctaagctctttaaagctgtttttctccattgtcatagtgccttctctgaaaaatgaatgtacaggtatcctattttctaatgtaattaggattttttaaaagcaatttttgatagtttttcttttaaaaagtaaaattcagcactgtgacttgaacccccaaatctttcacatacaggtgaaacattaagccacaaataaaaataatgaacaagaaagaagacaagatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatcacaacacca

SEQ ID NO: 1801 - DNA, 1920 bp, Homo sapiens
  ENST00000538786
aaacaccaaagctgtctctcacactggtggttccaggataaagcctcggcctggggcctggtctgcacgttaggcgccggccgcagctcgcaggaggacccgagccagcccgccccttcccgcacagcctgctgggagttgtagttcagtcgtcggagaaccacgccaagccccgccccagatgagtgcgcagtatgaggaccgctggccgggacccagtgagcgcgggactacaattcccaaaggacggtagcactcagcgccccgccaacagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacgg

SEQ ID NO: 1802 - DNA, 714 bp, Homo sapiens
  ENST00000540699
ccaggcctagttaaacaccaaagctgtctctcacactggtggttccaggataaagcctcggcctggggcctggtctgcacgttaggcgccggccgcagctcgcaggaggacccgagccagcccgccccttcccgcacagcctgctgggagttgtagttcagtcgtcggagaaccacgccaagccccgccccagatgagtgcgcagtatgaggaccgctggccgggacccagtgagcgcgggactacaattcccaaaggacggtagcactcagcgccccgccaacagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactg

SEQ ID NO: 1803 - DNA, 828 bp, Homo sapiens
  ENST00000535789
cgccaagccccgccccagatgagtgcgcagtatgaggaccgctggccgggacccagtgagcgcgggactacaattcccaaaggacggtagcactcagcgccccgccaacaggtacccggcggctcgcttcgcgcacacgcggcaggcggtggcgggattctgccgcgtgcgctttcccgccccgcctcgcctagcctcgtcctgcgctcgccacgcctcgggctgtccgttgggccacgcagaccgcgctgcgctcgctccgtcgcggctccgcgtgccccaccttctggctagttttttctagagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagtgtaatgtgtgtgctgttgaaatgaccgtttcacttgcgaaatcgaagagcaaaaaggaaaagaacagtgaagaatttttaaatgagtctcagttctcaaattcaaatacgaagcaatggaacgttttgtcagtcttagaataacggaccaaaaatatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcag

SEQ ID NO: 1804 - DNA, 1893 bp, Homo sapiens
  ENST00000469442
acacaacctcaccagccacgggcaccccagtcttcagctacacccaagtctgggatgcaagggggccttagcagctggctgacccaggatgcccaaggtcaccattccctagactctaggcatcatgccacatgctgcacatgctgcgtctttgagtccttgcagccgtgtgaggcacggtatcattactcccgttttacagaggaagctactgaagctcagagagtacctgagcagccctggagaaggagtgtcacttttcctccatctctgccactgactggctggatgcacaggaggactgggtctccagacaggagtgtaaagggcacgagggttgcttgtccttatcagaggtttcctgagcaccagcctttagagacagggaggaaggcaagagtgcgcctttgaggaacgcacaagcccaggagttccaacagggctgcagtggaggctaagttgcagcaggacttttgagcaagcatgcacacaggccagcaagagcaattggaggctatggtgccgtgctactcatatgggcagaagctgtccaaactggccatcctgaggatcgcctgtaactacatcctgtccctggcgcggctggctgaccttgactacagtgccgaccacagcaacctcagcttctccgagtgtgtgcagcgctgcacccgcaccctgcaggccgagggacgtgccaagaagcgcaaggagtgactggctgcaggcaagaccaaggccaccactgtgggccctccttccagtcaggcctgaggacaaggtgagctcgctgagtccagcctcgtggtcttctccaagatgccgccagatgcccagcctacagcctctcagggtcggatcggagcacgcctgcctccctctcccctccgccctcacccagccaatccgaggctgcttcgcactttgccctctgcctggtggggaggggagagctcagcccccgactcactcagaccccaaggcccactgtccagctgcagaaattcgttgccaaagattggacagagacaccgaaggaaatggggtggtgaaaccccacagcgaaaagccacaccgttgctctgtgacttttgctcctcctgttgcctgagccccatctcaagccaaagatgagtcagtggttctgctaggaactcatggaatggatgggcatttgatgacccctgggggtcatcttggccctctgacctggtgctctctctccactgggccttgtgctggctgagtgcaagacaagccttaggggctgtgagagggaggctggggtgcctgggcggggctgggagtgggacctgagatccctgcccactctctccccttcattggctgcccaggccactggccccagttctcagtgtcccttgggtccaggctccttgggccctaagcatcaccagaagggagtaagcagggagagaagcaatattactccctcccctacaccagggacttgccccagggcagctacctatgggtctttgcttccccagccagcctctcctcactgtgacccacccccatgggcccccgtcccaggcagccagcaccatgggcaggccctgccatggacagaaaaagagtttttctcttgttcagcctgcacgtggcctgaggaaggagtagaggctgggttggctggagccgtcctactgggcaagatggcgccccacttggagggcggtggtctgttacagggtgtgcaggggcagagaaggaagggaccaggggactgggccagtatgtggaggatggggcctgcgtgttcaaagccaaggcccgccccttccttgtgctcaaatggccaaagctgttcacgtctgtgctcaaccatctgcttcaaattgaagtaaaagccccaaaatgtcaagaaaa

SEQ ID NO: 1805 - DNA, 2438 bp, Homo sapiens
  ENST00000306279
ctcgcgaactgggcttctgtgtaaactgaggctaaacaaacacagatggagcgcagcgggcgttctccagaaatgctggcaaggaggcagcgacttcagatgacactctgagcgctccgggaacggacagcccggcggcttcccgaagccggcggcgcagctgcccggggcgagggggagaaagggagagagggagggggagggcgggcgaagcgggagagccagagactcctcggcgctgagcgcggcggcggcccgggcagccccacgcccctgcctcgcgcgccgcccgcgccatgaagcacatcccggtcctcgaggacgggccgtggaagaccgtgtgcgtgaaggagctgaacggccttaagaagctcaagcggaaaggcaaggagccggcgcggcgcgcgaacggctataaaactttccgactggacttggaagcgcccgagccccgcgccgtagccaccaacgggctgcgggacaggacccatcggctgcagccggtcccggtaccggtgccggtgccagtcccagtggcgccggccgttcccccaagagggggcacggacacagccggggagcgcgggggctctcgggcgcccgaggtctccgacgcgcggaaacgctgcttcgccctaggcgcagtggggccaggactccccacgccgccgccgccgccgcctcctgcgccccagagccaggcacctgggggcccagaggcacagcctttccgggagccgggtctgcgtcctcgcatcttgctgtgcgcaccgcccgcgcgccccgcgccgtcagcacccccagcaccgccagcgcccccggagtccactgtgcgccctgcgcccccgacgcgccccggggaaagttcctactcgtcaatttcacacgtaatttacaataaccaccaggattcctccgcgtcgcctaggaaacgaccgggcgaagcgactgccgcctcctccgagatcaaagccctgcagcagacccggaggctcctggcgaacgccagggagcggacgcgggtgcacaccatcagcgcagccttcgaggcgctcaggaagcaggtgccgtgctactcatatgggcagaagctgtccaaactggccatcctgaggatcgcctgtaactacatcctgtccctggcgcggctggctgaccttgactacagtgccgaccacagcaacctcagcttctccgagtgtgtgcagcgctgcacccgcaccctgcaggccgagggacgtgccaagaagcgcaaggagtgactggctgcaggcaagaccaaggccaccactgtgggccctccttccagtcaggcctgaggacaaggtgagctcgctgagtccagcctcgtggtcttctccaagatgccgccagatgcccagcctacagcctctcagggtcggatcggagcacgcctgcctccctctcccctccgccctcacccagccaatccgaggctgcttcgcactttgccctctgcctggtggggaggggagagctcagcccccgactcactcagaccccaaggcccactgtccagctgcagaaattcgttgccaaagattggacagagacaccgaaggaaatggggtggtgaaaccccacagcgaaaagccacaccgttgctctgtgacttttgctcctcctgttgcctgagccccatctcaagccaaagatgagtcagtggttctgctaggaactcatggaatggatgggcatttgatgacccctgggggtcatcttggccctctgacctggtgctctctctccactgggccttgtgctggctgagtgcaagacaagccttaggggctgtgagagggaggctggggtgcctgggcggggctgggagtgggacctgagatccctgcccactctctccccttcattggctgcccaggccactggccccagttctcagtgtcccttgggtccaggctccttgggccctaagcatcaccagaagggagtaagcagggagagaagcaatattactccctcccctacaccagggacttgccccagggcagctacctatgggtctttgcttccccagccagcctctcctcactgtgacccacccccatgggcccccgtcccaggcagccagcaccatgggcaggccctgccatggacagaaaaagagtttttctcttgttcagcctgcacgtggcctgaggaaggagtagaggctgggttggctggagccgtcctactgggcaagatggcgccccacttggagggcggtggtctgttacagggtgtgcaggggcagagaaggaagggaccaggggactgggccagtatgtggaggatggggcctgcgtgttcaaagccaaggcccgccccttccttgtgctcaaatggccaaagctgttcacgtctgtgctcaaccatctgcttcaaattgaagtaaaagccccaaaatgtcaagaaaa

SEQ ID NO: 1806 - DNA, 3099 bp, Homo sapiens
  ENST00000463422
gcatcttgctgtgcgcaccgcccgcgcgccccgcgccgtcagcacccccagcaccgccagcgcccccggagtccactgtgcgccctgcgcccccgacgcgccccggggaaagttcctactcgtcaatttcacacgtaatttacaataaccaccaggattcctccgcgtcgcctaggaaacgaccgggcgaagcgactgccgcctcctccgagatcaaagccctgcagcagacccggaggctcctggcgaacgccagggagcggacgcgggtgcacaccatcagcgcagccttcgaggcgctcaggaagcaggtgccgtgctactcatatgggcagaagctgtccaaactggccatcctgaggatcgcctgtaactacatcctgtccctggcgcggctggctgaccttgactacagtgccgaccacagcaacctcagcttctccgagtgtgtgcagcgctgcacccgcaccctgcaggccgagggacgtgccaagaagcgcaagagcctcatcatcactcaggatacaacagcgcgagcagctggtttggaggcagcagggaaaaccgtgcaaaaggttctttgtgagagaggaaactcgcttatgaataacaggactggacgccgtaaaagttggcggctggaattcttgtttctcaggcgccgctgttttctcttgactttttatctctggtttttatttttttcccgttttcttttaatgttgtttcttcctcttctcacatcagttgtgacttttcttcctcctctgcgagcccgaaggccacctcattagtgctcctgacactgcggaacttttctttctcaaggctgttgtcactggggatggttgaaagtgactattttcctaagaaaacagctggaggggacatgggagcaagaaggtgcttgggagcgcatctcagtgttgaggctcaaaacaggcagcgccatggcagagtcattccgccgtcaccctgaataaaccccatgcacacagacgagaacaatgtctcctcagagggagggtctgggagaccggacaccatgcagagacccccatcagctcatcagagagcttcacggagatgttctgggaggacaatcacattcataaatacgccggtgcctcggctctgccgctgactgcagcatgacatgaagccttttttaagaactggctgctgccgccaaagccttctgggatatgtctgcctggaacctgggcacctcctgggagcagtcactgggtggcctgtcaggggctgtggggtcctggggcagggccggcaactggaagccagccctggggaggaaaggagagaagggcaaggctgggctgctttcctcacagcccctggacactgagggaggagctgagttgggcctggggctgccatgtgtcagacagtggtgatgtgatggggggacacaggtcagtggcagggtactgggagtttcccctttcctttctcagttctttgcacccattttccatgggctgcctccccagatccagaagccccagcagcccctcaccccagcagtggaaaaagcccgtcattgacacggctgtgggtggccggctttgcaaaagcctcacatttggggctttggagggctttttgcatttcatctttacacaggctcctgcacctcattcctcttgccctcctctcagctttcctcccacttccagttagagagatggcagctctggcaggaccaaatattgatgtttatcacagttttagggccatttgtctcaccatctgaagggctcagcgcaggcccacgggatcctctctccttgagtgacctctgggggcaggtatctggtttggatgctggagctggtccctactcttcccttgggggccgtgcggccgggtgctcaagtgttttaacctcaggaccctgattagttatcatgaagctaccccaccagctcctgggtctgttcatggattagtggcataaaggacgtaatattgttttgcaaaatctgctctccctcccatgtctcctgcccaagaagttggtcttcgtggggccaaaggcaaggaggacccgaggaaggaagaggaaccactgtccccagcccctggtatggcatggcgtcagcctagtgaccagaaattgcttttgaactctgaggcttccagaggacaagaggaagaggaggacagggctgccctgcccactgctcagccttgagccctgcacctggcacagtgcgaggcctcagacagggtgtcagcaggccctggctccccacatcccatccttaaacaggccatgccctttctacctgccccagcagaccagaaagcagtttccatgggaaacaacaaaccttccttgtgctcccaggataagtgtttctagagggtgaagtcgggagccattctctcctttaacatcttgccacctctgcccagaattcacagccaccggcgcctgtcttagctgccctggctgtcagccccaccagagcccctcctggctgctctgctgaaagctggtcagactgcctcactccatcccctacttagctcccctaaggcctagggggctccctacaggccaagggatgaggccagactcaatagaacacctgataggccccccaagtgacctggccctggccggtcactccctatgtcccaatttacaccccagcagcacagaactccttgctcaaaggggctatttttggcctctgtgctcatgccatcccttctgcctggaatgcccttctccactgtctgcctggctaactcctgctcattctggaaggctcagctcctcctgaaagccctccctgaccccaaccccagctccttcctcagggtgtcgtagcacagggatgcttttggtctaattcaggagagcatcatgtgatatgcttttaaagtaatgagttaaaatgttagacaatatgaaactctattatgtgatatattagatttcatgtcattacattgtattatattatatttttaggtggtatgctatgtgacataggatgcgatgtgatattacatcccatgacactatgttacacagtgttggattaaatgcctgtgtctctggctaga

SEQ ID NO: 1807 - DNA, 715 bp, Homo sapiens
  ENST00000473116
gtcacggagaatctgtgccgctcagactccggtggaagctgcttgatgtagtccttgaagctctgtgagctgcccaggcattgctactccgactttccagatgaggaaacggaggctctgaggagtgaaggcacttcccaaagtcacaccgcttgtgccgtgctactcatatgggcagaagctgtccaaactggccatcctgaggatcgcctgtaactacatcctgtccctggcgcggctggctgaccttgactacagtgccgaccacagcaacctcagcttctccgagtgtgtgcagcgctgcacccgcaccctgcaggccgagggacgtgccaagaagcgcaaggaaagttcttctgcacggccttgactgactccgaggtttgcaaacatccactggcttcagtgaaggaggggtttgaccactggccctaccttgctcctgacctggggcctgtggggcagctgtctgcacagcacggctgaggcctgtgccagtcccctcctctctggtccctggggagcttggaggccagaagcccaggctttgcgcctgtgcccagaataacctctgcaaagtctgtcccttggagaagatgtgaaagcagatctgtcaaacgcaaggatgtccaggcttgagtgttaaagaaaacaccagtgcagcttatgatgcagcttgtacagcgtaattccacttttcgtaaaatactgtatg

SEQ ID NO: 1808 - DNA, 1288 bp, Homo sapiens
  ENST00000489682
tgtcccttggagaagatgtgaaagcagatctgtcaaacgcaaggatgtccaggcttgagtgttaaagaaaacaccagtgcagcttatgatgcagcttgtacagcgtaattccacttttcgtaaaatactgtatgagtgactggctgcaggcaagaccaaggccaccactgtgggccctccttccagtcaggcctgaggacaaggtgagctcgctgagtccagcctcgtggtcttctccaagatgccgccagatgcccagcctacagcctctcagggtcggatcggagcacgcctgcctccctctcccctccgccctcacccagccaatccgaggctgcttcgcactttgccctctgcctggtggggaggggagagctcagcccccgactcactcagaccccaaggcccactgtccagctgcagaaattcgttgccaaagattggacagagacaccgaaggaaatggggtggtgaaaccccacagcgaaaagccacaccgttgctctgtgacttttgctcctcctgttgcctgagccccatctcaagccaaagatgagtcagtggttctgctaggaactcatggaatggatgggcatttgatgacccctgggggtcatcttggccctctgacctggtgctctctctccactgggccttgtgctggctgagtgcaagacaagccttaggggctgtgagagggaggctggggtgcctgggcggggctgggagtgggacctgagatccctgcccactctctccccttcattggctgcccaggccactggccccagttctcagtgtcccttgggtccaggctccttgggccctaagcatcaccagaagggagtaagcagggagagaagcaatattactccctcccctacaccagggacttgccccagggcagctacctatgggtctttgcttccccagccagcctctcctcactgtgacccacccccatgggcccccgtcccaggcagccagcaccatgggcaggccctgccatggacagaaaaagagtttttctcttgttcagcctgcacgtggcctgaggaaggagtagaggctgggttggctggagccgtcctactgggcaagatggcgccccacttggagggcggtggtctgttacagggtgtgcaggggcagagaaggaagggaccaggggactgggccagtatgtggaggatggggcctgcgtgttcaaagccaaggcccgccccttccttgtgctcaaatggccaaagctgttcacgtctgtgctcaaccatctgcttcaaattga

SEQ ID NO: 1809 - DNA, 1458 bp, Homo sapiens
  ENST00000400270
ggaataagaggggtaaatggaatagctgcatagcaacttggctctcaagcatcttaaatgttatcccttgacttctggcttccatggtttctgatgagaaattggctgctaatcttactgaagatcccttatagtgaatctgaatggtgcctaccctaagctggtgcctttcagacctgcaggacggctgatctctccacctctgctactctctgtgattttcaacattcttctcagcctggccatgcatattgcaggcttcatcctggttcagaggcagccttggtattccgtggagatacacagtgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatatgtgatctttcctcttaggacaggacaatactttcctttttataaaaatgagttgaggggaagtagtactgtgtatactcacggagttgtaatttttgaatttttacttcatcgatggaaaaactaatgcgtgggaaacattacaccaatctttactgtctgggttccttttctctgtagtacttttcagatttgaggctttttcttctgtttctggccttacccaacatattgttaaggataagcttagcctatgctgcaataaaaaacaactctcagata

SEQ ID NO: 1810 - DNA, 3056 bp, Homo sapiens
  ENST00000428352
ctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggaaatggctttttctggggacgatttccacatcaagggagtgccggcacatgccatggtagttaagccctgcagaacagccagccaggtcccagtggaaggaattgcaatcctgcatcagttcccattctcatcggcactgcaaagaatgacagtcattgtccaagagatgggaggtgaccgactggcattcatgaaaggtgcaccagagagggtggccagcttttgccaacctgagacagtacccactagttttgttagcgaacttcagatttacacgacacagggcttccgagtcatagcactggcctacaagaagctggaaaatgaccatcacgctactaccttgacgagggagacggtagaatcagacctgatatttctggggctgctgatcttggagaatcgattgaaggaagagacaaaacctgtcttggaagagctcatctcagcccggataaggactgtaatgatcacaggtgacaatcttcagactgcaataacagtggccagaaaatctggaatggtttctgaaagccagaaagtcattctcattgaggcaaatgaaaccaccgggtcctcatcagcatctatatcttggacgttagtagaagagaagaaacacattatgtatgggaatcaggacaattacattaacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggattactttgtaggtatgtgtggtgatggagccaatgactgtggggctctgaaaatggctcatgtgggcatctcattatcagagcaggaggcatctgtggcctcacctttcacttccaaaactccaaacattgagtgcgtacctcaccttatcaaggaaggacgtgcagctctcgttacctccttttgcatgtttaagtacatggctctgtacagcatgattcagagacaaacagcctttcaaattaccagtttctgttccaggatctggccattacaactcttattggtgtaacaatgaatctgaatggtgcctaccctaagctggtgcctttcagacctgcaggacggctgatctctccacctctgctactctctgtgattttcaacattcttctcagcctggccatgcatattgcaggcttcatcctggttcagaggcagccttggtattccgtggagatacacagtgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatatgtgatctttcctcttaggacaggacaatactttcctttttataaaaatgagttgaggggaagtagtactgtgtatactcacggagttgtaatttttgaatttttacttcatcgatggaaaaactaatgcgtgggaaacattacaccaatctttactgtctgggttccttttctctgtagtacttttcagatttgaggctttttcttctgtttctggccttacccaacatattgttaaggataagcttagcctatgctgcaataaaaaacaactctcagat

SEQ ID NO: 1811 - DNA, 3658 bp, Homo sapiens
  ENST00000450950
ggcgagttggagttcatcctggaagcgtctgcacgacaaggtcagggaggaggtgtggaataactttttcatgggacactttgagaagggccagcacgctctgctcaatgaaggagaagagaatgagatggagatatttggctatcggactcaaggctgccggaaaagtctctgccttgccggatccatcttctcatttggaatcctccccttggtgttttactggagaccagcatggcacgtatgggcacattgtgtcccatgttccttgcaagaagcagacactgtgttgctgaggacaacgatgaggagtatatcataaatagagccataagaaagccagacctaaaggtgagatgcatcaaagtgcagaaaataagatatgtttggaactacttagaaggacagttccagaaaattggttctttggaagactggcttagttctgccaagatacatcaaaaatttggatcaggcttgacaagagaagaacaggagattagcaatctgtaaaactccaccatctcgtcgagtcacataatagcattacggtctctgtatgtgggagaaaagctggagttcaagagctggaatcacgcgtcctggtgcctggagatttattaattttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggaaatggctttttctggggacgatttccacatcaagggagtgccggcacatgccatggtagttaagccctgcagaacagccagccaggtcccagtggaaggaattgcaatcctgcatcagttcccattctcatcggcactgcaaagaatgacagtcattgtccaagagatgggaggtgaccgactggcattcatgaaaggtgcaccagagagggtggccagcttttgccaacctgagacagtacccactagttttgttagcgaacttcagatttacacgacacagggcttccgagtcatagcactggcctacaagaagctggaaaatgaccatcacgctactaccttgacgagggagacggtagaatcagacctgatatttctggggctgctgatcttggagaatcgattgaaggaagagacaaaacctgtcttggaagagctcatctcagcccggataaggactgtaatgatcacaggtgacaatcttcagactgcaataacagtggccagaaaatctggaatggtttctgaaagccagaaagtcattctcattgaggcaaatgaaaccaccgggtcctcatcagcatctatatcttggacgttagtagaagagaagaaacacattatgtatgggaatcaggacaattacattaacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggattactttgtaggtatgtgtggtgatggagccaatgactgtggggctctgaaaatggctcatgtgggcatctcattatcagagcaggaggcatctgtggcctcacctttcacttccaaaactccaaacattgagtgcgtacctcaccttatcaaggaaggacgtgcagctctcgttacctccttttgcatgtttaagtacatggctctgtacagcatgattcagtatgttggtgttctgctgctctactgggagacaaacagcctttcaaattaccagtttctgttccaggatctggccattacaactcttattggtgtaacaatgaatctgaatggtgcctaccctaagctggtgcctttcagacctgcaggacggctgatctctccacctctgctactctctgtgattttcaacattcttctcagcctggccatgcatattgcaggcttcatcctggttcagaggcagccttggtattccgtggagatacacagtgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatatgtgatctt

SEQ ID NO: 1812 - DNA, 4016 bp, Homo sapiens
  ENST00000392443
gggaggagttcagtttgccaagtattgtcatttgttgagagaaggtgtgtgctcaaggaggagttttaacctggaggatcattaactcttttagtcagctgaggagctgcggtggctcggcgagttggagttcatcctggaagcgtctgcacgacaaggtcagggaggaggtgtggaataactttttcatgggacactttgagaagggccagcacgctctgctcaatgaaggagaagagaatgagatggagatatttggctatcggactcaaggctgccggaaaagtctctgccttgccggatccatcttctcatttggaatcctccccttggtgttttactggagaccagcatggcacgtatgggcacattgtgtcccatgttccttgcaagaagcagacactgtgttgctgaggacaacggatgaattccaaatttactcttggaaaaaggtaatatggatctacctgtcagcattaaacagcgcatttggtctcactcctgaccaccctctcatgacagatgaggagtatatcataaatagagccataagaaagccagacctaaaggtgagatgcatcaaagtgcagaaaataagatatgtttggaactacttagaaggacagttccagaaaattggttctttggaagactggcttagttctgccaagatacatcaaaaatttggatcaggcttgacaagagaagaacaggagattaggaggttaatatgtgggcctaatactatcgatgttgaagttacaccaatttggaaactgctcatcaaggaggttctaaatccattttatatatttcaactcttcagtgtctgtttgtggtttagtgaagactataaggaatatgcttttgccatcataatcatgtccataatttccatatctttgacagtatatgatctcagagagcaatctgtaaaactccaccatctcgtcgagtcacataatagcattacggtctctgtatgtgggagaaaagctggagttcaagagctggaatcacgcgtcctggtgcctggagatttattaattttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggaaatggctttttctggggacgatttccacatcaagggagtgccggcacatgccatggtagttaagccctgcagaacagccagccaggtcccagtggaaggaattgcaatcctgcatcagttcccattctcatcggcactgcaaagaatgacagtcattgtccaagagatgggaggtgaccgactggcattcatgaaaggtgcaccagagagggtggccagcttttgccaacctgagacagtacccactagttttgttagcgaacttcagatttacacgacacagggcttccgagtcatagcactggcctacaagaagctggaaaatgaccatcacgctactaccttgacgagggagacggtagaatcagacctgatatttctggggctgctgatcttggagaatcgattgaaggaagagacaaaacctgtcttggaagagctcatctcagcccggataaggactgtaatgatcacaggtgacaatcttcagactgcaataacagtggccagaaaatctggaatggtttctgaaagccagaaagtcattctcattgaggcaaatgaaaccaccgggtcctcatcagcatctatatcttggacgttagtagaagagaagaaacacattatgtatgggaatcaggacaattacattaacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggattactttgtaggtatgtgtggtgatggagccaatgactgtggggctctgaaaatggctcatgtgggcatctcattatcagagcaggaggcatctgtggcctcacctttcacttccaaaactccaaacattgagtgcgtacctcaccttatcaaggaaggacgtgcagctctcgttacctccttttgcatgtttaagtacatggctctgtacagcatgattcagtatgttggtgttctgctgctctactgggagacaaacagcctttcaaattaccagtttctgttccaggatctggccattacaactcttattggtgtaacaatgaatctgaatggtgcctaccctaagctggtgcctttcagacctgcaggacggctgatctctccacctctgctactctctgtgattttcaacattcttctcagcctggccatgcatattgcaggcttcatcctggttcagaggcagccttggtattccgtggagatacacagtgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatat

SEQ ID NO: 1813 - DNA, 4208 bp, Homo sapiens
  ENST00000342695
aggcaatgagttctttccctgtaagttgggcacaaaaagatcggcatgggagcagcctcctttgagacagctgctctgagagaatgcaataagcagggagcagccagcaattcctcctagcagagggcgactcgtgggaggagttcagtttgccaagtattgtcatttgttgagagaaggtgtgtgctcaaggaggagttttaacctggaggatcattaactcttttagtcagctgaggagctgcggtggctcggcgagttggagttcatcctggaagcgtctgcacgacaaggtcagggaggaggtgtggaataactttttcatgggacactttgagaagggccagcacgctctgctcaatgaaggagaagagaatgagatggagatatttggctatcggactcaaggctgccggaaaagtctctgccttgccggatccatcttctcatttggaatcctccccttggtgttttactggagaccagcatggcacgtatgggcacattgtgtcccatgttccttgcaagaagcagacactgtgttgctgaggacaacggatgaattccaaatttactcttggaaaaaggtaatatggatctacctgtcagcattaaacagcgcatttggtctcactcctgaccaccctctcatgacagatgaggagtatatcataaatagagccataagaaagccagacctaaaggtgagatgcatcaaagtgcagaaaataagatatgtttggaactacttagaaggacagttccagaaaattggttctttggaagactggcttagttctgccaagatacatcaaaaatttggatcaggcttgacaagagaagaacaggagattaggaggttaatatgtgggcctaatactatcgatgttgaagttacaccaatttggaaactgctcatcaaggaggttctaaatccattttatatatttcaactcttcagtgtctgtttgtggtttagtgaagactataaggaatatgcttttgccatcataatcatgtccataatttccatatctttgacagtatatgatctcagagagcaatctgtaaaactccaccatctcgtcgagtcacataatagcattacggtctctgtatgtgggagaaaagctggagttcaagagctggaatcacgcgtcctggtgcctggagatttattaattttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggaaatggctttttctggggacgatttccacatcaagggagtgccggcacatgccatggtagttaagccctgcagaacagccagccaggtcccagtggaaggaattgcaatcctgcatcagttcccattctcatcggcactgcaaagaatgacagtcattgtccaagagatgggaggtgaccgactggcattcatgaaaggtgcaccagagagggtggccagcttttgccaacctgagacagtacccactagttttgttagcgaacttcagatttacacgacacagggcttccgagtcatagcactggcctacaagaagctggaaaatgaccatcacgctactaccttgacgagggagacggtagaatcagacctgatatttctggggctgctgatcttggagaatcgattgaaggaagagacaaaacctgtcttggaagagctcatctcagcccggataaggactgtaatgatcacaggtgacaatcttcagactgcaataacagtggccagaaaatctggaatggtttctgaaagccagaaagtcattctcattgaggcaaatgaaaccaccgggtcctcatcagcatctatatcttggacgttagtagaagagaagaaacacattatgtatgggaatcaggacaattacattaacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggattactttgtaggtatgtgtggtgatggagccaatgactgtggggctctgaaaatggctcatgtgggcatctcattatcagagcaggaggcatctgtggcctcacctttcacttccaaaactccaaacattgagtgcgtacctcaccttatcaaggaaggacgtgcagctctcgttacctccttttgcatgtttaagtacatggctctgtacagcatgattcagtatgttggtgttctgctgctctactgggagacaaacagcctttcaaattaccagtttctgttccaggatctggccattacaactcttattggtgtaacaatgaatctgaatggtgcctaccctaagctggtgcctttcagacctgcaggacggctgatctctccacctctgctactctctgtgattttcaacattcttctcagcctggccatgcatattgcaggcttcatcctggttcagaggcagccttggtattccgtggagatacacagtgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatat

SEQ ID NO: 1814 - DNA, 872 bp, Homo sapiens
  ENST00000482964
tgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgagctctaagaagaactactgttttcacgtcaattaaggaggacaaaaaaaccttgctgcaggaaagtagaataactcatctggctaagtttccaagaggctgagacggttatatggatctttaacagccccgcagccagcagatggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaa

SEQ ID NO: 1815 - DNA, 228 bp, Homo sapiens
  ENST00000474776
tcatctacaattaatgtggttccctcttagttactttgtaggtatgtgtggtgatggagccaatgactgtgggggaaggacgtgcagctctcgttacctccttttgcatgtttaagtacatggctctgtacagcatgattcagtatgttggtgttctgctgctctactgggagacaaacagcctttcaaattaccagtttctgttccaggatctggccattacaactc

SEQ ID NO: 1816 - DNA, 565 bp, Homo sapiens
  ENST00000437904
caatcttcagactgcaataacagtggccagaaaatctggaatggtttctgaaagccagaaagtcattctcattgaggcaaatgaaaccaccgggtcctcatcagcatctatatcttggacgttagtagaagagaagaaacacattatgtatgggaatcaggacaattacattaacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggagtaggttctttgccagtgcaggtggcatgaactgcatggaggcataacagtcagggggagtggaagagttactttgtaggtatgtgtggtgatggagccaatgactgtggggctctgaaaatggctcatgtgggcatctcattatcagagcaggaggcatctgtggcctcacctttcacttccaaaactccaaacattgagt

SEQ ID NO: 1817 - DNA, 3070 bp, Homo sapiens
  ENST00000490925
attaactcttttagtcagctgaggagctgcggtggctcggcgagttggagttcatcctggaagcgtctgcacgacaaggtcagggaggaggtgtggaataactttttcatgggacactttgagaagggccagcacgctctgctcaatgaaggagaagagaatgagatggagatatttggctatcggactcaaggctgccggaaaagtctctgccttgccggatccatcttctcatttggaatcctccccttggtgttttactggagaccagcatggcacgtatgggcacattgtgtcccatgttccttgcaagaagcagacactgtgttgctgaggacaacggatgaattccaaatttactcttggaaaaaggtaatatggatctacctgtcagcattaaacagcgcatttggtctcactcctgaccaccctctcatgacagatgaggagtatatcataaatagagccataagaaagccagacctaaaggtgagatgcatcaaagtgcagaaaataagatatgtttggaactacttagaaggacagttccagaaaattggttctttggaagactggcttagttctgccaagatacatcaaaaatttggatcaggcttgacaagagaagaacaggagattaggaggttaatatgtgggcctaatactatcgatgttgaagttacaccaatttggaaactgctcatcaaggaggttctaaatccattttatatatttcaactcttcagtgtctgtttgtggtttagtgaagactataaggaatatgcttttgccatcataatcatgtccataatttccatatctttgacagtatatgatctcagagagcaatctgtaaaactccaccatctcgtcgagtcacataatagcattacggtctctgtatgtgggagaaaagctggagttcaagagctggaatcacgcgtcctggtgcctggagatttattaattttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggaaatggctttttctggggacgatttccacatcaagggagtgccggcacatgccatggtagttaagccctgcagaacagccagccaggtcccagtggaaggaattgcaatcctgcatcagttcccattctcatcggcactgcaaagaatgacagtcattgtccaagagatgggaggtgaccgactggcattcatgaaaggtgcaccagagagggtggccagcttttgccaacctgagacagtacccactagttttgttagcgaacttcagatttacacgacacagggcttccgagtcatagcactggcctacaagaagctggaaaatgaccatcacgctactaccttgacgagggagacggtagaatcagacctgatatttctggggctgctgatcttggagaatcgattgaaggaagagacaaaacctgtcttggaagagctcatctcagcccggataaggactgtaatgatcacaggtgacaatcttcagactgcaataacagtggccagaaaatctggaatggtttctgaaagccagaaagtcattctcattgaggcaaatgaaaccaccgggtcctcatcagcatctatatcttggacgttagtagaagagaagaaacacattatgtatgggaatcaggacaattacattaacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggagtaggttctttgccagtgcaggtggcatgaactgcatggaggcataacagtcagggggagtggaagaggtaccaggagtcactcagtttgacaagggcagtggtccgtacttcggctgcatgagataatcacttgggagctttggagaaaatagcagtaccaagggatctcaccattcagagatcctgattcagttgtttatatggggcttaaaaaatcagtattttttttcacttaagtcaattttgcattcaatgctgagaaccactggactagaacctaagggtcctgaaagagtgtggggagaaataagaatggaaaggtggcttgagctcagctcctggagggacagtgagaatttatttgtatatgccgtcatcacaatgatgatatagggatattcatatgacaagagattcatgcaacattaaaaatactaaaat

SEQ ID NO: 1818 - DNA, 2157 bp, Homo sapiens
  ENST00000295548
atgggacactttgagaagggccagcacgctctgctcaatgaaggagaagagaatgagatggagatatttggctatcggactcaaggctgccggaaaagtctctgccttgccggatccatcttctcatttggaatcctccccttggtgttttactggagaccagcatggcacgtatgggcacattgtgtcccatgttccttgcaagaagcagacactgtgttgctgaggacaacggatgaattccaaatttactcttggaaaaaggtaatatggatctacctgtcagcattaaacagcgcatttggtctcactcctgaccaccctctcatgacagatgaggagtatatcataaatagagccataagaaagccagacctaaaggtgagatgcatcaaagtgcagaaaataagatatgtttggaactacttagaaggacagttccagaaaattggttctttggaagactggcttagttctgccaagatacatcaaaaatttggatcaggcttgacaagagaagaacaggagattaggaggttaatatgtgggcctaatactatcgatgttgaagttacaccaatttggaaactgctcatcaaggaggttctaaatccattttatatatttcaactcttcagtgtctgtttgtggtttagtgaagactataaggaatatgcttttgccatcataatcatgtccataatttccatatctttgacagtatatgatctcagagagcaatctgtaaaactccaccatctcgtcgagtcacataatagcattacggtctctgtatgtgggagaaaagctggagttcaagagctggaatcacgcgtcctggtgcctggagatttattaattttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggtaagcctctgctcttcagagaatctgagaagcttcttcaatgccagagcaacataggcaatatcagagctatctaattcttataaaaggtgaggtttccaatgtggagtacatttggtagtgaagggcaaaccaatctaaggctggtttcctcatctgtgcaatgaagctaataatagcatctacataatgagattgtgaggattaaatgagatgatgcagtaagaaaatccttggcactatgcctggcaaatattaaaggttcgatcatattaatataattgtacttattatgcagttatttcttgtctctctgtactgttctccgagcattgtctggtttcgaagattttccagaatatggggatcagaaaacattgctttctccagtgctcaggataactcatagattcacggggactataagtcttatttctattaatttcatattgattttatttccaagactagaaagaacaaaaa

SEQ ID NO: 1819 - DNA, 560 bp, Homo sapiens
  ENST00000489140
agtgcgtcgggaacggactggagcaatccatcgcctctcacggggccccgccctcttgcttccgatttggaattcggaattagccttgcagacttctcttttctgtcctcatcgaaaagacagccagcttttgtaaccttgccttggggatgttagcaggagaaatgttggcaattcaaggctcttctggttttataagaaaaccagattttgctgggaggcctggagtagaagagagggtcttggagaagcaaacatgggaggagagacattcccagagatcaggaagaggagatatttggctatcggactcaaggctgccggaaaagtctctgccttgccggatccatcttctcatttggaatcctccccttggtgttttactggagaccagcatggcacgtatgggcacattgtgtcccatgttccttgcaagaagcagacactgtgttgctgaggacaacggatgaattccaaatttactcttggaaaaaggtaatatggatctacctgtcagcattaaacagcgcatttggtctcactcctgaccaccctctcat

SEQ ID NO: 1820 - DNA, 654 bp, Homo sapiens
  ENST00000418797
agcgcccggggaggccatccgcaggtgggcgcggggcctggattccacagaggggcggagtccctcagtcaggcgctggctgcaatcacacccgagcgccagccccctccagcatccctgagtcccagaggagatcgccgaagcgctggaaaagccgttccgcccacgacttctggtgccgggtcggcggcgactgggggagcccagttccgagaccgtaccgcacccactgcggacctcctgggccctacatagttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcag

SEQ ID NO: 1821 - DNA, 3654 bp, Homo sapiens
  ENST00000295598
ctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaa

SEQ ID NO: 1822 - DNA, 1728 bp, Homo sapiens
  ENST00000488733
agagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccgggtatgttctagtttgaaagctgttgtacaaaatcctagttttccgtattatattttcccctgtattacatacaggtctaacctcaggggctctagtaagaaaatgacagacaccatctgcgtatctaccatgtgacatgcacagaatttgggcatttatatgctaccgtttcttttccctgaaactttttgaaagtagatgttattttcttttccctattttatagcagttgagagccagtaagtgggaacaccaggacttgcagttggcttcaaagccatgcttatgccttgaccttttgatgataaattttccctttatttttctacatttgttaaatagagttgaatctttcacctagttgaatcttcaacaattcccatttttgcacttttcccagctagcccattgcagtgtgttatggttatactatcatttgtttagttattctatcatttagttggaaattgttttgtacaaaaattaaagaaaccttttcataaaataggcgttatgtatccttgttatgtagaggattttgatattaaatgtgtaacaaatgttataaaagtaaatagtctagggatgtcttatttccagataatcactgaaatgtctgggaataacttgaatagcaagccaatatgtagcattttttcagtaaggcatcaagagacatgggtactgtggtattctgatatatattggtttttgtccacagttcctggttcataactcccatagcccttattacagtcgtttgttataatgttgggtgtgttagacctcagtggcaggcttcaagaaacaggatctctctcctgccctccttttcacctgtcgcaaggcaggactctaatcttgttccacttttctgattttccaggtagatagtgttggaattgaattggaggaaaccttggtggtggggagaaaccgccacacctttgctcacagaagtcatcttctgtgttgattgttggggtgtaagagtagagaagaggccgggtgcggtggctcatgcctgtaatctcagcactttgggaggctgagactggtggatcacctgaggtcaggagttcgacaccagcctgaccaacatggagaaaccccgtctctactaaaaatacaaaattagcctggcatggtggtgcatgcctgtaatcccagctactcgggaggctgaggcaggagaactgcttaaacctgggaggtggaggttgcagtgagccaaggttgtgccattgcactccagcctggacaacaagagtgaaactccatctcaaaaaaaaaaaaaaaaaa

SEQ ID NO: 1823 - DNA, 698 bp, Homo sapiens
  ENST00000369494
caagagctgtaccgaaagaggcaccaacaaatgtggttgctccataatggagagaatgtcaagaatgttgactatctttagacctgcttcattaatagataagatagaaactaaagaacccacccagttggaagaagttattagtcaagtagtgctgcacacgtgaccacagaagttaaaaaggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtga

SEQ ID NO: 1824 - DNA, 584 bp, Homo sapiens
  ENST00000463382
cgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcaggtaccagacgctttgtccttccccagtggatgacttgacagccccaagcatgtcagcctgtgaattagtgtgaagttaaggttttccaagtattacatgactcatcagagagatggatgtcttctaccccacccaaaaccaacctattttccttctatccaaaaagtggtagcctttcttttgaatgtaaactctgaatacaggcacaccatgtaacagcaatatctcttaaactggcgagcaagcttttgtaacttgtgtaaataaaaaagtgaataata

SEQ ID NO: 1825 - DNA, 666 bp, Homo sapiens
  ENST00000491156
ccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtaagaggcaggtgatggtcaccctgactcagatcagcttgcacgaatgttacactcttccgctatcctattctaaggtattgccaacttatgttttattctggatgtttgatatagttcttcttgagagccacatcacgtggtgaattttgacagtgagaaaacctcagcatttgtttatacgtaagataaccccaaagcatacattttgcttttaaattatcacgtggtcc

SEQ ID NO: 1826 - DNA, 579 bp, Homo sapiens
  ENST00000440951
agacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaagactctgacgcagtacagttaatctgtgcacaggaaagaagagctgtttgaagaggttattcggtaaatgcagagaatgtctttgtagtataaattattgctctatataaaactgcttgtaagtttt

SEQ ID NO: 1827 - DNA, 611 bp, Homo sapiens
  ENST00000479960
acctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaagtaagttgatcctctggtagctccaaaaagtatgaaatagtatgtgtggcttttccccccattacttgtggtaatagttgttattttcagaattttgagtggtatgtacaaaaattcctatgggttggaaaactgtgaaagcttgacatgtcagtaaatcagactaacaaatcctgaggcttccatgatagcagctagtgtttaggatttggcccaagataagataaagccacacaggctctagctccatggaactgctcaacagcgaactgcattgagcactcaggtctgccacagctgtagtccagttgtctttagaggccaactgggggtatgctggagcgtaggcgcccaggctcaaatcttgatttgcttgct

SEQ ID NO: 1828 - DNA, 417 bp, Homo sapiens
  ENST00000495965
aacgcacatacgctgctgcgatgaaggtcatgggcatttcctgatgcaaaagatttgaaacactctgagactttagcttttgacaaggggaccccagagaacgttaagccagtgtttctctgacagctctaagaagccctggtcttctgggaaaccctggagggagcaaggcaaaaggaaggctctgaacttcacacctgattttccaccagaacatttctgcccttttctgtgtgacaatcctttgaatagaaagttctacagccaaacatttgatttaggaagagcaggactctgacgcagtacagttaatctgtgcacaggaaagaagagctgtttgaagaggttattcggtaaatgcagagaatgtctttgtagtataaattattgctctatataaaactgcttgtaagtttt

SEQ ID NO: 1829 - DNA, 3572 bp, Homo sapiens
  ENST00000369496
gatatgtaataatgtctttgcaaagcaaagaatataaacagtataaaagtactagcatttagatgtattgtatcatttaatccttaaaaacatgaaatgaggttggcactattctttatctccacgctgtggaagaggaaattgaaatgtagaagttagtaacttgcctaaggatacactgctggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatgg

SEQ ID NO: 1830 - DNA, 3763 bp, Homo sapiens
  ENST00000537345
agcagcgggggcggccccgggactgagccggcatccctgagcctggctcccctccctgcgaccgccgtcacctccttctccttccttttccctccgccctccgtgccctgaggaaaggcgcgctcctccccttcccctggggcgctccgccggggcctcctcccgggcctccgttcccgccgcggccccggttccggcgggggcagcctccgggttcggggctccttctcctggggacgctggggcttagcttgctccgcgcagaggcggccgccctcccccaaagaaaaaactggctgcttctaagtgcgaagccggctgggcgggctggtgccagaaagggtgtgtcttcactgccctaagatggcctttaaggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatgg

SEQ ID NO: 1831 - DNA, 3114 bp, Homo sapiens
  ENST00000472488
ctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagtgagtgcccacccccatggcacctacccacccaggctctgggcacactcaccaacccacacaggccaagcttccaactcagccctggaccagagctgtaaggagggcatcagattttaatcttccatctgtatatccatagataggtttcatatagaagagagaagccat

SEQ ID NO: 1832 - DNA, 481 bp, Homo sapiens
  ENST00000478587
gtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggtgagggaactgctgggccatggaggaggggccccatgctgggagagctgtccctgcagcccattgcactcagagaaactccgtgtcccccatgctgctcaactcacccctgtgccctgcagtaccctcatatgcatcttagatacctcctccccaaagtaactcaccctcccttccccaggatgaccacaagctgtccttggatgagctgggccgcaaataccaagtggacctgtccaaggtgagtggaggggcttctagggaa

SEQ ID NO: 1833 - DNA, 5421 bp, Homo sapiens
  ENST00000361216
gtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaa

SEQ ID NO: 1834 - DNA, 3338 bp, Homo sapiens
  ENST00000392233
ccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaacctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtcc

SEQ ID NO: 1835 - DNA, 641 bp, Homo sapiens
  ENST00000468587
gtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggtgagaagccaggctgccccctgtaggaaagagtctgaatcctgaatccatagtcaggatgaagggctctggtagtacttacctggcaaaagctctgccattggtggggcaattgaggggtcagggggccctgaatattatggaaacaccctccacagagcagggtattgactgagggcagcctgactccatgggaaatgtatctcccttccccagggagatctctgttctgtccaccccaagactgagtggatttcaaagctttcaggtattgggttaagaacccctt

SEQ ID NO: 1836 - DNA, 4413 bp, Homo sapiens
  ENST00000447527
tccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaa

SEQ ID NO: 1837 - DNA, 444 bp, Homo sapiens
  ENST00000463989
gaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggtaagcccctccacattccccccagcaaagtgcaagccccaccaccagctcctccctccaggaccacacgcaga

SEQ ID NO: 1838 - DNA, 634 bp, Homo sapiens
  ENST00000459972
gctcatcctgcggcggtatcctggtgaatggacagctgctcccttagactctcgttcgtcacctgaagaggccctgtgggcgtttgcattttcaccctcgacctattctgccccagcctccaatgtgctaaatacaagtctcccctaaaggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccc

SEQ ID NO: 1839 - DNA, 3818 bp, Homo sapiens
  ENST00000441343
gaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggtgagggagctcggcaaggcagccgaggggggcggggggcagcagggtctcaggcagctggtcccaggctcccctcgccctgctggatggctctgccacctggttcccactcttctctctcttcccatctctccgggcacccactctgtcttctcacgggtctctgtctgtgtggtttccttgtctctctccctctctgtccctctctctgctgggcggctcgccttgcctgtctctctccatctcttactctgtctctttctttccttctttgtctctccaggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaa

SEQ ID NO: 1840 - DNA, 3597 bp, Homo sapiens
  ENST00000302102
tcccgcggacgcgggcatatgaggaggcggaggcggcggccgccgcagcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaa

SEQ ID NO: 1841 - DNA, 3458 bp, Homo sapiens
  ENST00000602133
aagatgggggtaggtgctgagccggctgggcgccgcttccgtgtgacattgtggggccggtgacattgggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagag

SEQ ID NO: 1842 - DNA, 3618 bp, Homo sapiens
  ENST00000545399
atatgaggaggcggaggcggcggccgccgcagcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatggggtctggtggctctgacagctatcgtatcgccacctcgcaggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagag

SEQ ID NO: 1843 - DNA, 3427 bp, Homo sapiens
  ENST00000543770
gtgtgtgtgtgcagcccctcatgtaggggagcaggcatgggaggctgggaggaggagaggaacaggagagccacggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctgg

SEQ ID NO: 1844 - DNA, 970 bp, Homo sapiens
  ENST00000485672
cggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtaaggccaggctcctgggtctgggtggggagggcctgggggtctgggctcctgggtctgagggaggaggggctgggatcctggacccctgagtctgagggaggaggggctagaggcctggacccgtgtgtctgggggaggaggggctgggatctggacccctgggtccggagaaggggctgggggcctggatcacagtattcttgtgaaagacaacttgggcctgactcagagggcctcattaacaaagcaaacaatcaaagaaagaaacaaacaaaaatcttgagaaacactggcaagccgtaaagagccaacaatcctattgcaaaattaagaagtgcacgctcatgatgaaaagttgaagagtacatcaagttaaaaaataaaataatgaggctgggtgcactggctcacgctgtaatcccagcactttggggggccaaggcgggcagatcagctgaggtcaggagttcaagactagcctggccaacatggtgaaaccctgtctctactgaaaatacaaaattagtggggcgtggtggcacatgcctgtaatcccagctactcaggaggctgaggcaggagaatcgcttgaacctgggaggcggaggttgcagtgagccaagatcacgccattgcactccagcctgggtgacaagagtga

SEQ ID NO: 1845 - DNA, 889 bp, Homo sapiens
  ENST00000473086
gagaagactggagaaagaatagagggctgagaccagaggtgaagcgggagggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttca

SEQ ID NO: 1846 - DNA, 603 bp, Homo sapiens
  ENST00000468774
gtgtgtgtgtgtgtgtgtgtgcaggctccgcagtgtcgcagcctggggctgcagtgtgtgtgtgtgcagcccctcatgtaggggagcaggcatgggaggctgggaggaggagaggaacaggagagccacggtggggagactgagtgcacagctgagggtgtgcgtgtgcaactgtgtagtggggagcgtgcatgcctggctgtgtccttgcctctgtgtccgtgtgtccttgtctgtctgtgagtctctccagcagatgccgcctccctccctggctgaccacctgacccttgctgcagccctggattcctccctgacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggct

SEQ ID NO: 1847 - DNA, 255 bp, Homo sapiens
  ENST00000465007
gaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcaggtgtggccaggctgtgggctgggaccctgggaactagggaggaggagctgggggctaggacccctgggtctgagggaggaggggctgtggctggtgtcttaagttctgggggt

SEQ ID NO: 1848 - DNA, 169 bp, Homo sapiens
  ENST00000636197
tgtgtgcggagatccgcgaggttgtgggccagccctcagcatctccgcctgaccttgtgcggttgcatgtgcacagttgcatgacaagaaagatgacaaggactcacccaagaagaacaagggcaaggagcgccgggacctggatgacctcaagaaggaggtggctatg

SEQ ID NO: 1849 - DNA, 100 bp, Homo sapiens
  ENST00000636258
aaaggggtagtcagtgatggctgtcaggacaagaaagatgacaaggactcacccaagaagaacaagggcaaggagcgccgggacctggatgacctcaaga

SEQ ID NO: 1850 - DNA, 100 bp, Homo sapiens
  ENST00000636282
ataaaggctgatgggcccagggatggaggacaagaaagatgacaaggactcacccaagaagaacaagggcaaggagcgccgggacctggatgacctcaag

SEQ ID NO: 1851 - DNA, 100 bp, Homo sapiens
  ENST00000637406
cacatggaagatcccagagagaggcagagacagagatagaggaaggacaagaaagatgacaaggactcacccaagaagaacaagggcaaggagcgccggg

SEQ ID NO: 1852 - DNA, 718 bp, Homo sapiens
  ENST00000494797
atcatgaccatcaccaccaacaccactggcaccaccactgcagtcattcagggagtcctgaacagaggccgattggtgttcctgcttgggaggatctgtgggaatcggcaggagaatgagtcagggaaatagtgcttagctgacattttgaaatggaagaagctggaatatatgaatttttgtaaagaaaaaaaaatgcagcctgtgagtctctcttgattgaaaattaaagggttaataatgcatcacacttcaagttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttc

SEQ ID NO: 1853 - DNA, 1883 bp, Homo sapiens
  ENST00000367815
aattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccgcccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaa

SEQ ID NO: 1854 - DNA, 2608 bp, Homo sapiens
  ENST00000367816
gcccacaaggggcacagccgggcagtcaggaaccggggctgccggctgggctggcctgcaaagaagagggaagggccggaactgcaaccgcagtggcggggagtgcgagggggcggcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccgcccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaattttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattc

SEQ ID NO: 1855 - DNA, 580 bp, Homo sapiens
  ENST00000577026
agatgcaacatggacacagaattctggggaacctacaacgtgtgggagttcagccagactccagatgagtataaggcttgatgattcgccccaagactgagaaccttgatgtcattgtcaatgtcagtgacactgaaagctgggaccagcatgttcagaagctcaacaagttcttggagccttacaacgactctatccaagcccaaaagaatgatgtctgccgccctggacgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtcatcaacttctatgcaggagcaaaccagagcatgaatgttacctgtgctgggaagcgagatgaagatgctgagaatctcggcaacttcgtcatgttccccgccaacggcaacatcgacctcatgtacttcccctactatggcaaaaagttccacgtgaactacacacagcccctggtggctgtgaagttcct

SEQ ID NO: 1856 - DNA, 3153 bp, Homo sapiens
  ENST00000250111
ccacctctctctgcctttttgtaccccgctttttttctgcgttctgctcggtttttgtagccgtctgtttttgcaccccatttcgttttgtttctagacggtttggtggggggtgaagctgcattcataccccttcctcttgttattctcccctgctctgacagcaccccttttcatcgcagttggggggcctaggatcggtgcatcttccgccgcgctgccagcaccccgcagcgcgtggtcgtgcaccccggaatctgcagcagctgcatatctgaggggggtctcctttgcccgcgccgccttcgctccccgtgcttttgggtgtgtggagggcttcagcgcgcggcgcccccgcttctccgcaaccccccgccccgcgcccggactcgccccgcgccaccaagatggtcatccagaaagagaagaagagctgcgggcaggtggttgaggagtggaaggagttcgtgtggaacccgaggacgcaccagtttatgggccgcaccgggaccagctgggcctttatcctcctcttctacctcgttttttatgggttcctcaccgccatgttcaccctcaccatgtgggtgatgctgcagactgtctccgaccatacccccaagtaccaggaccgactggccacaccgggcttgatgattcgccccaagactgagaaccttgatgtcattgtcaatgtcagtgacactgaaagctgggaccagcatgttcagaagctcaacaagttcttggagccttacaacgactctatccaagcccaaaagaatgatgtctgccgccctggacgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtcatcaacttctatgcaggagcaaaccagagcatgaatgttacctgtgctgggaagcgagatgaagatgctgagaatctcggcaacttcgtcatgttccccgccaacggcaacatcgacctcatgtacttcccctactatggcaaaaagttccacgtgaactacacacagcccctggtggctgtgaagttcctgaatgtgacccccaacgtggaggtgaatgtagaatgtcgcatcaacgccgccaacatcgccacagacgatgagcgagacaagttcgccggccgcgtggccttcaaactccgcatcaacaaaacctgaggccccttcctcccaccccatctctctcctgtggatgctcctggaatgtccctgaccctgcctgatccctccctcacccaccccaaaggtatttttgataacagagctatgacttgtctgagcctcacatccttttccttgacttctcaacccagcctgaagtccattgcggttccgtcactcgcctttcccaccaacttctcccaacctcagatcagtcagacagggagctgggctaagatggccacggaggagttaggagcctttctagttctggtttagctgtgagagctatccactctcctgcctgcatatcccctgagagttataggaagtgcccactgacccacccacccacctacaccccccgccacacacacacacaaacgtgcacacgcgtctcatttgacccctttgcttccagagatgaatgtggcactccctccttccattcctaagctctggccaccgtcccttgatctctcatactttctccctgtctacacagtcgccatcttggtgactttgaatttatctggctcctgggcaggtcttctcctcctctccatccctattccctcctctgaaatgcacccctttgtaattgaggacaaggtggttctgtggccttttccctctttgctggcacgttctgcttctcaccctctggtgactctgtgagctgggaaatgagggactggaagtgaggcctgtgttgacccttcctgaaaatcctctagcagcccccgacttcagcagtttctttctttgtttttttgagatggagtttcgctcttgttgcccaggctggagtgcaatggtgcaatctcagctcactgcaacttccgcatcccaggttcaagcgattctcccgcctcaggttcccgagtagctgggactacaggcatgtgccaccatgcccggctaatttctttctttctttttttttttttttgcattttttagtagagatgggggtttctccttgttggtcaggctggtctcgaactcccgacctcaggtgatccacctgcctcggcctcccaaagtgttgggattacaggcgtgagccaccgcgcccggccttcagtttcttcctaggccgttctgtcacccaaatagctgctacccagaggggcggggttgacctaggctgaatatccactttgtttttatggatggctcccttcccccattcgccttcccagaatatccttcaagttccacttcccagggagctctgggggaggggcggccattctggctccgtccccagtggccaccttggaaacatcggctggctttgggactattccacctccttcccctgagcccagatctgcccccaccatcctttctctggcttcttttagcaagttatcaactaatcactaactccttccttttcctctgcatgccagcctgaaaattccaaatctagcctctgaatgtcttggctccatctcttcagacccctttgcctttaaaaaaaaaacaaaaacaaaaacaaaaaaacccataatgcccacagaatgtcaaatgaggggcctcctgcctcctgctctgaatattctgtagctgtagaggcattttaaccctttgtcctccagcatcccttcacttcctcatcctctctaacctcctttttctttttttaatgctgcagcctccacactccacccacaggtggacccttccctttttctctagctggatctgtgtttcttcccttcgggcccccatgttttcctgcacccgccctaccatggtctctctctgcagttatttaatgcctgtgtcagatctactgtaaaaagaggattaagtaaaataaaatgagagcaattatatatataaatatatatcatacaca

SEQ ID NO: 1857 - DNA, 557 bp, Homo sapiens
  ENST00000577113
acgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtcatcaacttctatgcaggagcaaaccagagcatgaatgttacctgtgctgggaagaggccccatcaccatagaaacaaggggaaactgattcctgaggatgggcgagatgaagatgctgagaatctcggcaacttcgtcatgttccccgccaacggcaacatcgacctcatgtacttcccctactatggcaaaaagttccacgtgaactacacacagcccctggtggctgtgaagttcctgaatgtgacccccaacgtggaggtgaatgtagaatgtcgcatcaacgccgccaacatcgccacagacgatgagcgagacaagttcgccggccgcgtggccttcaaactccgcatcaacaaaacctgaggccccttcctcccaccccatctctctcctgtggatgct

SEQ ID NO: 1858 - DNA, 734 bp, Homo sapiens
  ENST00000475483
gtcacagagcccagagagcgtcctgtaggaacgtcacagagcccagagaacgcctggggacggtcggggaggcagttcggggaggggacgattaagttccctcagagaggaagccgcgggccgactggagtcgttttcgtgctctccgcacccgcccgccgcgggtagcatcttctcagcgccccggcgcccaggaacgcccaggaaacccagtcctcctcctaagcaacctgcggcgcggggacgcccgccttttgctattattataaacgtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattg

SEQ ID NO: 1859 - DNA, 1811 bp, Homo sapiens
  ENST00000286371
ccaagcggccgcccggcgcggcgcggcgcagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtgga

SEQ ID NO: 1860 - DNA, 1951 bp, Homo sapiens
  ENST00000465172
aagcggccgcccggcgcggcgcggcgcagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagacaaataatgtaaaagatggaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatat

SEQ ID NO: 1861 - DNA, 1708 bp, Homo sapiens
  ENST00000466678
cgaagaacgagaagaagtccctcaaccagagcctggccgagtggaagctcttcatctacaacccgaccaccggagaattcctggggcgcaccgccaagagctggggatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgt

SEQ ID NO: 1862 - DNA, 837 bp, Homo sapiens
  ENST00000462082
cttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataa

SEQ ID NO: 1863 - DNA, 418 bp, Homo sapiens
  ENST00000495216
cttgaatttggacagtgaaaaggcccttaaaaaggatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttt

SEQ ID NO: 1864 - DNA, 569 bp, Homo sapiens
  ENST00000482635
gtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgtaagtattgagaagttcttatgtggtgattactcttttgggaagctggagcatgtgttgacgtaccacttgtctggggtaggtagacgccagccctgtttaatttgtgcgtcatct

SEQ ID NO: 1865 - DNA, 421 bp, Homo sapiens
  ENST00000487199
ataattggattaaagcctgaaggagtgccaaggatagattgtgtttcaaagttagttggcgtgctagtcatcagtgctatctgagatttaatgaaatatggtgcattttccttaagacaaataatgtaaaagatggaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaa

SEQ ID NO: 1866 - DNA, 657 bp, Homo sapiens
  ENST00000484727
attctaggttggcaccttgtggtggctgttgctttccagtctggaagcacagcattttattcatttcaggaaaacatcggtcctaaacctgctggtgcattcctgctgttagtagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgt

SEQ ID NO: 1867 - DNA, 229 bp, Homo sapiens
  ENST00000486782
aagaggatttcttttgttttcaacttcagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtca

SEQ ID NO: 1868 - DNA, 4675 bp, Homo sapiens
  ENST00000397041
ggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 1869 - DNA, 4182 bp, Homo sapiens
  ENST00000397035
ggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccgggttggcctctttgaagaaatgagccagaagtgagcgctgggaacagagtggagtctccgggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 1870 - DNA, 776 bp, Homo sapiens
  ENST00000574999
ccgcctctgctcctgggctgcagtggacgctgtgggtgtggagcgcagagcctctctgtctgcacatcggggaggcgttctcggatcaccaagtggagggtgtgaaggggctctggtggctgggtcccaaggtgtccgcagggtcttgcactgcaggggacctgggctcactgggccagcaacgggagcacctcttgggccacactgcctcactgtcttcacctgccaccccctacatggccagggcactgtgtgctcttctgggcctcagcctctgacccctctgcacccagcctgtctttatccaggccttctcaggacagtctcgcaggcctggagtaggcagccgctgaccacctcttggaccccagaccacaccggaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttg

SEQ ID NO: 1871 - DNA, 989 bp, Homo sapiens
  ENST00000570773
ccagctgtaaatggaatcttaataacagtgaacagggcctgcgtagccttcatcttctataccgcaaaggtgaattccactcccgcatggttttgttggttgattttcacatgcatttccctattcagtgatctccaggctcccgctagcctccccaggctaatgccagctgttctccttctgagccgctgcactcctgctccagaacgtctgcctttcccacgctgtgcccttgcttctccctggcacggtgcagctctccccaccgccgccccgaccccgcacccctcccgggatccccagcccaccccacggcagtgttttgtgtgctggttgtgcccaggcgtgggccaagggcaggatgaggcttccctcctcccacccaccagcccctcgcctgacctgccgctctctctgacctgccacggtgcccccagaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccg

SEQ ID NO: 1872 - DNA, 604 bp, Homo sapiens
  ENST00000570845
gagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccggggccagggacacagcatcgtctcgctgtcagagctgctcagagagggaggaagcagggaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggc

SEQ ID NO: 1873 - DNA, 3290 bp, Homo sapiens
  ENST00000359983
atggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccgggttggcctctttgggccagggacacagcatcgtctcgctgtcagagctgctcagagagggaggaagcagggaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggc

SEQ ID NO: 1874 - DNA, 3274 bp, Homo sapiens
  ENST00000352011
ccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccggaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggc

SEQ ID NO: 1875 - DNA, 3197 bp, Homo sapiens
  ENST00000397043
ccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaaatgagccagaagtgagcgctgggaacagagtggagtctccggtgtgtacctcagactgatggtgcccatgtgttcgcctccgccccccacc

SEQ ID NO: 1876 - DNA, 429 bp, Homo sapiens
  ENST00000572116
gagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgggccagggacacagcatcgtctcgctgtcagagctgctcagagagggaggaagcagggaagaaatgagccagaagtgagcgctgggaacagagtggagtctccggtgtgtacctcagactga

SEQ ID NO: 1877 - DNA, 868 bp, Homo sapiens
  ENST00000571245
tcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacggtgagtgggaggccccgtcccgcctccagcctgcctccccgcccgcctctgctcctgggctgcagtggacgctgtgggtgtggagcgcagagcctctctgtctgcacatcggggaggcgttctcggatcaccaagtggagggtgtgaaggggctctggtggctgggtcccaaggtgtccgcagggtcttgcactgcaggggacctgggctcactgggccagcaacgggagcacctcttgggccacactgcctcactgtcttcacctgccaccccctacatggccagggcactgtgtgctcttctgggcctcagcctctgacccctctgcacccagcctgtctttatccaggccttctcaggacagtctcgcaggcctggagtaggcagccgctgaccacctcttggaccccagaccacaccgggttggcctctttggtatcaccttgtgggtgggtcaaggggagggttgtttctgagctcacagctctgggtctgccttaaccc

SEQ ID NO: 1878 - DNA, 1159 bp, Homo sapiens
  ENST00000576957
ccgtgtgcgaatgtgtatttgtgtgcacatggcctgagtgcctgagtgagaggtgtgtgtaatgtgtatattttgcatgtgtgctctggtgcattttgagcgtgagtacaagcagaaggatttgtgccggcgtgtgactgtgcacacactcgtattcacatgtgaggatgcctgtggggaatggtgagcgtgtgtgttgctggacatggatggattctgcatctctgcacctcagggcagatatgtaggtgtttgcttgtgtttgccggatggtgtggcatgtgctaggtttttgcacatgtctgattcttgggcatgccctcttcgtgtgcgtgtgtgtgtgtgtgtgtgtgtgtgtgtgtgtgtacttggcctctgctaggcctaaagagcaggtatgtccaggatccagagctgggactggggaaggcaggactggccaggcccgaggcagagctgtgtacacacacccttcacatcacagctggcggagggaggaggggctgctgtggagacagtgggtgggtgagctcccagccttgggtctgagcaggagctggagcctgcatctgccgggggctaggcctaccggggctagagctcatgactctgttccagcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcct

SEQ ID NO: 1879 - DNA, 428 bp, Homo sapiens
  ENST00000572176
cctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctggtgagcaagggctggccagggagcctgttgaacttacagctcgagttgttggagttccaggggagatgggtctagagccgcatgggtggcctgcagtgtccttccccactcgctatacacgaataaacatccccacctggggagccgagctcagagcccacgggaaacccagagacaccagcacggacccccaagccaaaggcgcctccccatcccagtcagttagcggggaccaagaggcctcactgccagatgt

SEQ ID NO: 1880 - DNA, 894 bp, Homo sapiens
  ENST00000572694
gtccaggacattgggacaaaccggagccggacacatctggcagagcagacggtccctgcctcagcctggaccctgcgttctatttccctcctggtgggcacggacggccaggccggtttggccctcggtcgggcagggggcctgcaggaccccaccctggggtcgactggccgcccggggaggagggaggcgaccccgcccgcctaagcacgcccctgcgctccccagatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtac

SEQ ID NO: 1881 - DNA, 230 bp, Homo sapiens
  ENST00000574202
cagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtaagtagggccctgccagccatcctgtggtagtcggtagccctggagggagagccaggctgggca

SEQ ID NO: 1882 - DNA, 4826 bp, Homo sapiens
  ENST00000309890
atcctggcgcgggccggggccgccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccgggttggcctctttgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgg

SEQ ID NO: 1883 - DNA, 8593 bp, Homo sapiens
  ENST00000352432
agccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtgtgaagaagggggatggccttcagctaccagcagcagacggtgcggcagcttcaaatgctgcagatagtgcgaatgccagcctagtcaatggtaaaatgcaggatggcaatgtggacgccagccagagcaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 1884 - DNA, 8900 bp, Homo sapiens
  ENST00000383800
ggcgagatgctctcctagaaccggcgccggcgcctccgccccccgccccccacccgctcgggcaggatggtacagtctgcagaggggcccgggcacgctggctgggctcagccgcggcaccagctgccgcaccgcgattacggggctgcccgccgggaaaccgtgcaggattggtggtgattttcatagccaagagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 1885 - DNA, 9101 bp, Homo sapiens
  ENST00000460129
agctgaacttcgtcacccagtccctagagccagcaagacatgggccccagtttccagaccctgacacctctcatttaaccagaagacgtggaggggagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagattgaagtagtcaatactttcaagagcggggcctcctttcagggggccctgcggagacagtcctcggtcaccagccagagccaggatgtagccaatctctctagccctagtcgcgtgtcgttgtccaatgctctttcctctccgaccagccttcctcctgctgcagccgggcagggctagagaaccctggacacagagttcagcaagagagagtgaaattaaaagaggttgtgagtctttaaccttgagcctgaaatgaatgtgaatcaatcccagactcttggcttccttgaagccggatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 1886 - DNA, 8964 bp, Homo sapiens
  ENST00000397077
gggcagccgcggcagaggagccgcagccgcagcggggccgggccgggccgggcgcgcaccagcggcagcggcggcggcagcggcggcggcagcatctcgctctcggagccggcgcaggtttccctgtacttagagcgtggactgtgaacccccaagcagacgagctgaacttcgtcacccagtccctagagccagcaagacatgggccccagtttccagaccctgacacctctcatttaaccagaagacgtggaggggagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 1887 - DNA, 4016 bp, Homo sapiens
  ENST00000452124
gccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtaaaatgcaggatggcaatgtggacgccagccagagcaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaa

SEQ ID NO: 1888 - DNA, 907 bp, Homo sapiens
  ENST00000467702
attgaagtagtcaatactttcaagagcggggcctcctttcagggggccctgcggagacagtcctcggtcaccagccagagccaggatgtagccaatctctctagccctagtcgcgtgtcgttgtccaatgctctttcctctccgaccagccttcctcctgctgcagccgggcagggctagagaaccctggacacagagttcagcaagagagagtgaaattaaaagagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggttttt

SEQ ID NO: 1889 - DNA, 496 bp, Homo sapiens
  ENST00000468426
agccaggtccaagccacattctggacgccgtaccttgctagacagataaggcacctcctgctcccacttcccctgcagattcctggttctgacgactcctagggcaaggagtttgcactgttagggggagaaatgaagacaacaaaaagggaagaaagctggacttctcattagcgttttgatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctg

SEQ ID NO: 1890 - DNA, 1739 bp, Homo sapiens
  ENST00000480680
agtctgcagaggggcccgggcacgctggctgggctcagccgcggcaccagctgccgcaccgcgattacggggctgcccgccgggaaaccgtgcaggattggtggtgattttcatagccaagagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtaagcctaatccccttgcagaccaggagaggagctcttaaggccacattttttttttgtttatttgttcactcaacaaaatagttattgagtgccttctacgtccgcaccctgtgctgacagccacctcctgcatccttaaggcctgcatgggccaggtaggctctgtctgttccatctccaggtcttgtcccagtctctgtcttgtccaatcatgtcatggaggcccctccttcccctccgggccaggccaaggatgctgaccatgttgttgagtctccagcctcaagtggtggaaacagccagcatcaattggtcccatcatcactccagtattgagtagaaatccccacccattggaagcatattccttccaatattgtcaactccact

SEQ ID NO: 1891 - DNA, 3465 bp, Homo sapiens
  ENST00000638646
atgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagattgaagtagtcaatactttcaagagcggggcctcctttcagggggccctgcggagacagtcctcggtcaccagccagagccaggatgtagccaatctctctagccctagtcgcgtgtcgttgtccaatgctctttcctctccgaccagccttcctcctgctgcagccgggcagggctag

SEQ ID NO: 1892 - DNA, 8962 bp, Homo sapiens
  ENST00000360273
agtctgcagaggggcccgggcacgctggctgggctcagccgcggcaccagctgccgcaccgcgattacggggctgcccgccgggaaaccgtgcaggattggtggtgattttcatagccaagagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtgtgaagaagggggatggccttcagctaccagcagcagacggtgcggcagcttcaaatgctgcagatagtgcgaatgccagcctagtcaatggtaaaatgcaggatggcaatgtggacgccagccagagcaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 1893 - DNA, 4280 bp, Homo sapiens
  ENST00000349466
ccgccgccggtgcagagcgtggggagcactcggccgcagccctcgcccgccgcagagggtcgcgtcccgcgccgccggccaggccgccccgtgcccaggcctttccatccttggagcggatcgttgcccgcctgacgcccgcccgcagcgacagcgcccgccggagccgaggccgcggcggcggccgtgcccatgcccgggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggag

SEQ ID NO: 1894 - DNA, 6742 bp, Homo sapiens
  ENST00000370186
ccgccgccggtgcagagcgtggggagcactcggccgcagccctcgcccgccgcagagggtcgcgtcccgcgccgccggccaggccgccccgtgcccaggcctttccatccttggagcggatcgttgcccgcctgacgcccgcccgcagcgacagcgcccgccggagccgaggccgcggcggcggccgtgcccatgcccgggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggaatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatatttgcattcctcttatcaggcattttcatttggaaatttcattattgaatgtagcaaggttgtagttgtttttttttttttttcagggaactagactgcaagaatatctttctggtcaacccatttttgtccctcatcaccccgcccccacctttcgctcctgccctctgcccggccctactgagattcccaaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacggcagggacgcagccacagttcagaccctgtcccctcagcacctggatggactcccactgtttgctttggcaaatgccgaggagtcctcggtagaccaccttgatgtctgctgtgacatcagaggtgccaccaccaaagcactcttcccaccctagtctttgtgtccagcggccaagcttaagccatgaagtcatggatttgtggctcagcaccaggtcctgaggggagcgtatcctggcagtgtgggcacctggtggccaagcctcagtttcccccaaatgagcaaaggggataaagaggggcccgacttttgccaccctcctgaggaagcccctaggtccacacagtgatgccatgggggacccttgccttccacacttgcaggtgtcacgttttgcagggaggtgtttgggccttgggctcagccactgggagacagttgggacctgagggacagaggatcggaatggaaaccaccaacgtgcactggcaccctcagaaggcttgtctcacctccaccggcatccacacaaaaccaaacaggagcaggcgtcatccccactattcccatgaatgccatgtcacccctgagcagaagcagtcaaatcttgggcaaaagaatttcggttagaaaagaaaatcccactttaaaatgccagctgcagataactcaaagccatcccttttttctaaagggcacattgagaatgtcacccatttgtaaactgttccctgatgtccttgtttaaacgataataagaaaaagggcaactccatttgttgagggtctttgtgttcttcaatgagaaatcaaatttgagacgttgaaattggagctgcgtgctgctgcactcaccggcttcttctcactctctgtcgtagacacaccgataggaccaatggccaatagatattaaaagcaaaccctcactgctgctgtataaagttgcctaatgtaaatgtctattgtttagtccctaggtcacctttgtgctgtgctgtggagttcagaaacggggtaccatgacctggaatcttttgctcttgtttttgcagtcttcaaggctgggggccctgtctcattgggaagcccctctttataaagcattatattacttggaatggcttggtcaactgtgttcagttcataaatatgttttacatttttatctgcctgttataaagatgaacaaaaaaacttaatgagaaagatcacagatacgtaataatttaaagtctgtagttgaatttcctaacttaaagaatagaccaaaatttctgtgtataaaaaaaaatgaaaggctccttacatcctggtctgggtaa

SEQ ID NO: 1895 - DNA, 4064 bp, Homo sapiens
  ENST00000393842
cagccaacagtcgctctaaatgggccttactctaactgatggatcctgtctgccctatagcctgttgcattcatgaagacagtgagggttagcagagcaccccgaccccaccctgtcctccaggatggagactccacctcccaggactccaagttcctcccctgtgggccaggcccccattcactcattcctccaggcccccggccacatgcgggactgaccacgcggtagacttcctgccgactccataccacgtgtctcaaagagcttagggcccagtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatggca

SEQ ID NO: 1896 - DNA, 4234 bp, Homo sapiens
  ENST00000359149
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggaatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggag

SEQ ID NO: 1897 - DNA, 899 bp, Homo sapiens
  ENST00000460549
cggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcagttctggaagtttcctatgaatggaatcagacagtacgtggccttgtgtgtctggcttctgtgaggctgatttttaacgaacaactcagaggagctgagaaggaaggtccagttcagagtttctgcctcctcctgcccctgaggtgcaggagacaaggagagcagccctcactctgttgccccaaatggcagaccccatcgtcgggctgttttgtggtctggggtttttcacctcctgcgagggatttggagcacacctgctgccaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtg

SEQ ID NO: 1898 - DNA, 634 bp, Homo sapiens
  ENST00000496610
gctgtgcgccggcggtcttcggtcctcagccagcttcatgacatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggaga

SEQ ID NO: 1899 - DNA, 6420 bp, Homo sapiens
  ENST00000263519
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatatttgcattcctcttatcaggcattttcatttggaaatttcattattgaatgtagcaaggttgtagttgtttttttttttttttcagggaactagactgcaagaatatctttctggtcaacccatttttgtccctcatcaccccgcccccacctttcgctcctgccctctgcccggccctactgagattcccaaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacggcagggacgcagccacagttcagaccctgtcccctcagcacctggatggactcccactgtttgctttggcaaatgccgaggagtcctcggtagaccaccttgatgtctgctgtgacatcagaggtgccaccaccaaagcactcttcccaccctagtctttgtgtccagcggccaagcttaagccatgaagtcatggatttgtggctcagcaccaggtcctgaggggagcgtatcctggcagtgtgggcacctggtggccaagcctcagtttcccccaaatgagcaaaggggataaagaggggcccgacttttgccaccctcctgaggaagcccctaggtccacacagtgatgccatgggggacccttgccttccacacttgcaggtgtcacgttttgcagggaggtgtttgggccttgggctcagccactgggagacagttgggacctgagggacagaggatcggaatggaaaccaccaacgtgcactggcaccctcagaaggcttgtctcacctccaccggcatccacacaaaaccaaacaggagcaggcgtcatccccactattcccatgaatgccatgtcacccctgagcagaagcagtcaaatcttgggcaaaagaatttcggttagaaaagaaaatcccactttaaaatgccagctgcagataactcaaagccatcccttttttctaaagggcacattgagaatgtcacccatttgtaaactgttccctgatgtccttgtttaaacgataataagaaaaagggcaactccatttgttgagggtctttgtgttcttcaatgagaaatcaaatttgagacgttgaaattggagctgcgtgctgctgcactcaccggcttcttctcactctctgtcgtagacacaccgataggaccaatggccaatagatattaaaagcaaaccctcactgctgctgtataaagttgcctaatgtaaatgtctattgtttagtccctaggtcacctttgtgctgtgctgtggagttcagaaacggggtaccatgacctggaatcttttgctcttgtttttgcagtcttcaaggctgggggccctgtctcattgggaagcccctctttataaagcattatattacttggaatggcttggtcaactgtgttcagttcataaatatgttttacatttttatctgcctgttataaagatgaacaaaaaaacttaatgagaaagatcacagatacgtaataatttaaagtctgtagttgaatttcctaacttaaagaatagaccaaaatttctgtgtataaaaaaaaatgaaaggctccttacatcctg

SEQ ID NO: 1900 - DNA, 3376 bp, Homo sapiens
  ENST00000262429
gggtccggcccaggaggcttgggcgcgcgcagccatcccgggcctcgccggggacctagggacgcaggcaacgcctgcgcccgctcaccatggtcgagggacgcgtctccgagttcctgaagaaactcggcttctcgggcgggggccgccagtaccaggcgctggagaaggacgaagaggaagccttgattgatgaacagagtgagctgaaagccatcgagaaagagaagaaggtgacagccctgccccccaaggaagcgtgcaaatgccagaaagaggatttggccagagcgttttgtgtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctcggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccggg

SEQ ID NO: 1901 - DNA, 3472 bp, Homo sapiens
  ENST00000416219
gggtccggcccaggaggcttgggcgcgcgcagccatcccgggcctcgccggggacctagggacgcaggcaacgcctgcgcccgctcaccatggtcgagggacgcgtctccgagttcctgaagaaactcggcttctcgggcgggggccgccagtaccaggcgctggagaaggacgaagaggaagccttgattgatgaacagagtgagctgaaagccatcgagaaagagaagaaggtgacagccctgccccccaaggaagcgtgcaaatgccagaaagaggatttggccagagcgttttgtgtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctcggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagaggagttcccagaaaactgaagtgtgttgcactgcagtgagactgggagtagaaggcagaggagaaagtacctgggccggcagagctggcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataatta

SEQ ID NO: 1902 - DNA, 3600 bp, Homo sapiens
  ENST00000565631
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcgtcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctcggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttatt

SEQ ID NO: 1903 - DNA, 355 bp, Homo sapiens
  ENST00000569207
tgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccagcacatctgatgtgcttcctgccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggac

SEQ ID NO: 1904 - DNA, 504 bp, Homo sapiens
  ENST00000565546
agttctcagtgttctgggaatgttattcatcgatgcgttttggcagcaaaataggcttctggtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggg

SEQ ID NO: 1905 - DNA, 2782 bp, Homo sapiens
  ENST00000420010
agttctcagtgttctgggaatgttattcatcgatgcgttttggcagcaaaataggcttctggtttaagaaccccctgatcctgctgctgctgggctctgccctggtgagtgtcctcaccaaggagtatgaggacgccgtcagcatcgccacggcagtgcttgtcgtggtcactgtcgccttcatccagcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctcggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttatt

SEQ ID NO: 1906 - DNA, 548 bp, Homo sapiens
  ENST00000565927
attcatcgatgcgttttggcagcaaaataggcttctggtgacagggaactcatcacctcacaaggcagccctgttcctctgtctcaggagtctcaccattaggaattctaccttagcacggcgtaaggctctggacgggatggcagggaggcactaggctggtgctctgaggaggtggcatctgggcagagatctgagtgaaatgagacggaaagccatgtgaggatgtggatggagggcgtcgctggagggcagggtgcagagtccctgaggggacaggagcctggcagcctgggaatcaaggtgcccagaccagtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagctggttcctccagaatgtaactgcctaagagaaggaaaactccagcacctgcttgctcgagaactgg

SEQ ID NO: 1907 - DNA, 397 bp, Homo sapiens
  ENST00000568160
tctgccctggtgagtgtcctcaccaaggagtatgaggacgccgtcagcatcgccacggcagtgcttgtcgtggtcactgtcgccttcatccaggtgagtatttcctgaggtcccagtcagggtaagctgggcgggacaggagcttcatggagtccccacctttaaacagcacatctgatgtgcttcctgccaggagtacaggtcggagaaatctctggaagagctgaccaagctggttcctccagaatgtaactggtaagtcagagcctccctgggactttttggttcactggaggagccagggagctggagagtttggcaaatgtttgctgaaagttgtatccttggtagtgtcggacaagagaaccacatctcactgggagttctaaggcctggt

SEQ ID NO: 1908 - DNA, 575 bp, Homo sapiens
  ENST00000563340
gggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcaggtaagagtgctatggccgccccttgccttgccagggtggtcaatgggctctgagcccttccctgccgcaagagaaggtggggaggctgcagaataggaagggttgggaaggtgcagccccgtcacccaaactccagcctcccaatagcatgttctccgacaggtacagagtgcccggcgaatgcttgcaaaatgaatgacagcaaatgatccagggtgtcccttttgtattaggctgttcttgcattgct

SEQ ID NO: 1909 - DNA, 386 bp, Homo sapiens
  ENST00000564099
agactagaaccaggacactggggacacctaagacaagcttcaccagccaaaagcattgccagccccagctgagagtcacacactccttaaatgtgttagaggggactcatttgacctttcgatccagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtg

SEQ ID NO: 1910 - DNA, 878 bp, Homo sapiens
  ENST00000567892
gtgggtccccggaggcttggctggcagtggggctgggtcacagctttgaaatctgattcttcgtcttccccgtctccgtgtccaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcaccttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgt

SEQ ID NO: 1911 - DNA, 2003 bp, Homo sapiens
  ENST00000567222
tttctgctccctctgcctggatgctctctctgggcaacctgcatggctcattctcatgcttcattccagtcaccagtcactgccttcaggaagtcttccctgattgcactcccactcaatcccctcaccctgctgtatttttccctagagaggaagatacacacagacacacttttccttatggatctgattgtgatctgtctcccctttagaacatcagtttcatggaggcggagtttgtgtttcatccctgatgtctagagataaagggcttgccactcagtaggtgctcaggagtccacccgctccgccacttaatatccccttcaacaagctggccaagtggtgtgggggaaggaatgcgctttggagtcaggggacccatctggccacgtgtgcgtaaccgtatgagcacagagccagtgcttccgctggagctcagtgctgctgttatcaccagtgatagctgccaagggaaagagagtcctcatttgtgtccccaaagccaagtgtgagggttacctctcctgccagccctccctgggagcagaagtgggaccaggaagctggcctcagctgtgtctgagcggcagggcctcacccggccactcccaccataccgcctgctgcgggtctagcctcaaccctgctgtgtggagttggctggaggctggtctctctcagctgatgaggggctctgcggagggcggagcctggagcctgtttctccaggcgcaacgttggggggggtcccctcggggtgatggagatcatctgggtgtatggaactgtgtgtggttggccttacggggtggtcttccttcactgtctgcgggacagatggaggggcacagctgcccatggacccaggctctggggcttctggaaggtgccgaggagggcaggtgcgatgcctgggggcgttcagcaaatgcctggccctgccccctgtgccaacttggcctgggaggctcaggcacagctgtttcaagggtcctttatttcattcctggttcatttcaaagtgtctgtgtcttgttcggagcagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggg

SEQ ID NO: 1912 - DNA, 1491 bp, Homo sapiens
  ENST00000624933
agctgatgaggggctctgcggagggcggagcctggagcctgtttctccaggcgcaacgttggggggggtcccctcggggtgatggagatcatctgggtgtatggaactgtgtgtggttggccttacggggtggtcttccttcactgtctgcgggacagatggaggggcacagctgcccatggacccaggctctggggcttctggaaggtgccgaggagggcaggtgcgatgcctgggggcgttcagcaaatgcctggccctgccccctgtgccaacttggcctgggaggctcaggcacagctgtttcaagggtcctttatttcattcctggttcatttcaaagtgtctgtgtcttgttcggagcagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggaggtgagcgagggtcaccccggcctgttctccaagccctggtgcggtgcagacgctggggactgcagtccctgccctcctgccacagctcacatctgggagaggcaaacatgtacacacaccggacaatgtgatgccatcagaggcgtggggtgcatgaggcaaagggactgggtgacccttgaaagaagggaggtcgccaggtgtgtgcctgggaactacagaggccagcggggtggagatgactttgccgagacgggagttgaaatgtacatgaggacaggctgccccctgttcccttgtcaccaggaaacaatttgaaatctgctaaatatcctcctgtgttacactctagaggtgattgtttgctttggatctaggcctgggtcaccttttcatggcctgcaggttcagggagctctatgccaggacgggccacgatctaggtgggaaatgaggcaggtgacccatgtgaccacaccacagattgcccatgtgcaggaagcgggaggggaccctggccgggtaccctgcctccattttccctccagctctccctctactactgacggccatccttcagccttccttgtaggaaatgaccttcactctgggtttaactggagtggcatcacctcccagggagacagttacttcctggaggaagtggtgtttcctccacccataggtgccctgcccccatcctcatggtggcagcaaatcagcatgtgctggggagaccctggggtagcagccactgacctcacacctggaggaagctgtgtgaccgattcatgagcttgtaagtggctcccagccatgccccaggagcagtgaggcaggcctgtgccctttggttcaggatggaggttgtctcttcccgcctaacctctcacctttgtgctcaccttccagatgcctgaagacagagcaagcactccccgcaccacgacgatgacgttcacttgttttgtgttttt

SEQ ID NO: 1913 - DNA, 481 bp, Homo sapiens
  ENST00000567629
ccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcaggtgagacccgggctgaccctcctcgctgcagagctgctgtgtgttctcgacagcagcgccccgaccctgcccgcagcattgagcggctctggctcagcgtgggcagtcagagctcccctgcctgtacctggggtgtggacagcacacaatcccccgtgtgaccttctccctgcagaccaagctgatatttgagatcggctttctcaggaaccacatgttcctctactccgtcctggggtccatcctggggcagctggcggtcatttacatcccc

SEQ ID NO: 1914 - DNA, 292 bp, Homo sapiens
  ENST00000566874
atcatcatcagcgggaccctctttatcttctggaaggagctctccctctactactgacggccatccttcagccttccttgtaggaaatgaccttcactctgggtttaactggagtggcatcacctcccagggagacagttacttcctggaggaagtggtgtttcctccacccataggtgccctgcccccatcctcatggtggcagcaaatcagcatgtgctggggagaccctggggtagcagccactgacctcacacctggaggaagctgtgtgaccgattcatgagcttgt

SEQ ID NO: 1915 - DNA, 411 bp, Homo sapiens
  ENST00000472505
acgcgcttccctgccactgggttagggaaggcttgccggaaggacgatttcggaggacagcaggtgttagccaggcagcggagcgagcgccaacaggcgcactggggcggagagacgccgtgagcaaggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgca

SEQ ID NO: 1916 - DNA, 1298 bp, Homo sapiens
  ENST00000472174
acaggctaggacgcacggctgccagagaggacgccttaggggcccgcgagcaggctcgggaataaaacagggctggcagggcgaggtggagagactcgagaaggaccggccagatgtcgaagttcctagagaggagggcgcccaagcctccgccgagacgcgtgactacaactaccacaatccccagcgcctgcggttccagcgtcgccttgctctagacgggcggcggcgctgcgcggggaaccggcgtggggtcacgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtc

SEQ ID NO: 1917 - DNA, 1685 bp, Homo sapiens
  ENST00000532642
tgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcaggtgatgaatccccttgggaagcctctgtgtccttgtccccaacctagccttaccctccttctggagaagctgaagtgctctccttctctacctataactatagattcccccaaacagcttccacctcctcatttccatcttctggttttctcctacaggggctctctatttttgtctctgatttggtgtcactgacaacagccctgttctttttcccccctttctaatgcgttgtatctgtatagcacttagtcctccctctttctgttctctcattttatctgccatgcttttcatgtctccagtctgtatttgtgatctagactagaatggaattttgtctgtctatatcagtctgtcatggtgtgtttgactgtctctcggagctatgtgtatctccctctcacatgcctgtcagtaggacaccattgtctaaattgtgtgtgtctagtctgtctgacagtgtgtgagtttgtgactaaggatcagcctgagggtctgagtgtgactgtgggtgcttgactgagttgattcttagtgactagctttatccatatgccacttctctccgtctgtcccacagcgtaactctgtggttgtctgtccctgtctgccttgtctgtcacagtgtgtccatcctggttagtcatatatctcttgtggtctgtccatccaaccatgtgctagatgtcatcttctatcatttgtcactgccttacctattcctctgtccctgcctgatttctcctgttctttttttgcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgca

SEQ ID NO: 1918 - DNA, 944 bp, Homo sapiens
  ENST00000236067
gggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtct

SEQ ID NO: 1919 - DNA, 865 bp, Homo sapiens
  ENST00000471859
cgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggtgaggccgggtcctggcgggcgggagcagcatcgcggccgagctggccgggtcggaactcggcggggaagtggcctgcggggaatactggccccccgcgcgctctgcacccgaggctctggggacttgcgcctgcgagggcctctgactccgacaaaggagacccggatttccagctgcttgaggaggggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtg

SEQ ID NO: 1920 - DNA, 536 bp, Homo sapiens
  ENST00000472277
acagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggt

SEQ ID NO: 1921 - DNA, 530 bp, Homo sapiens
  ENST00000461670
agactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtggctgtactgtcacctgggggcagcctgaggacgccccttcagggaggtggcccttcagctcggcagctactttaggttgaagaacttctctctaccgagcagcccgtaaccccctttttctccctcactgctgcaggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcat

SEQ ID NO: 1922 - DNA, 2432 bp, Homo sapiens
  ENST00000468183
cggacggtggacgctgggacgcgtttgtagctccggccccgccgttccgacccccgccgccgtcgccgccatgacggggctagcactgctctactccggggtcttcgtggccttctgggcctgcgcgctggccgtgggtgaggccgggtcctggcgggcgggagcagcatcgcggccgagctggccgggtcggaactcggcggggaagtggcctgcggggaatactggccccccgcgcgctctgcacccgaggctctggggacttgcgcctgcgagggcctctgactccgacaaaggagacccggatttccagctgcttgaggaggggtgcgggcgggtaggggccgcgagggcagcactcccccgtcctgccactatcgctgtctcccctcgctcccacgtctcactgctgtcccccctttcttgctcctgaccggcccgctcggtcacaagccggctgctccggttcctcttttcccagtcgctttgccctcccccacccacagcttgttgggtaaacagcggaacggactgggccggcgggatctggctggagcgcttgctccctcggtcccgcctcggattcgggcttgcgggtggcgaccctgcctgcgcaggtgcttggtctgggaggtggttttagcgagggaatggcagaaaatggaggcctaagcagaggaatctgtctacacagctgtactgtcacctgggggcagcctgaggacgccccttcagggaggtggcccttcagctcggcagctactttaggttgaagaacttctctctaccgagcagcccgtaaccccctttttctccctcactgctgcaggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcaggtgatgaatccccttgggaagcctctgtgtccttgtccccaacctagccttaccctccttctggagaagctgaagtgctctccttctctacctataactatagattcccccaaacagcttccacctcctcatttccatcttctggttttctcctacaggggctctctatttttgtctctgatttggtgtcactgacaacagccctgttctttttcccccctttctaatgcgttgtatctgtatagcacttagtcctccctctttctgttctctcattttatctgccatgcttttcatgtctccagtctgtatttgtgatctagactagaatggaattttgtctgtctatatcagtctgtcatggtgtgtttgactgtctctcggagctatgtgtatctccctctcacatgcctgtcagtaggacaccattgtctaaattgtgtgtgtctagtctgtctgacagtgtgtgagtttgtgactaaggatcagcctgagggtctgagtgtgactgtgggtgcttgactgagttgattcttagtgactagctttatccatatgccacttctctccgtctgtcccacagcgtaactctgtggttgtctgtccctgtctgccttgtctgtcacagtgtgtccatcctggttagtcatatatctcttgtggtctgtccatccaaccatgtgctagatgtcatcttctatcatttgtcactgccttacctattcctctgtccctgcctgatttctcctgttctttttttgcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtca

SEQ ID NO: 1923 - DNA, 1664 bp, Homo sapiens
  ENST00000473485
ggacggtggacgctgggacgcgtttgtagctccggccccgccgttccgacccccgccgccgtcgccgccatgacggggctagcactgctctactccggggtcttcgtggccttctgggcctgcgcgctggccgtgggtgaggccgggtcctggcgggcgggagcagcatcgcggccgagctggccgggtcggaactcggcggggaagtggcctgcggggaatactggccccccgcgcgctctgcacccgaggctctggggacttgcgcctgcgagggcctctgactccgacaaaggagacccggatttccagctgcttgaggaggggtgcgggcgggtaggggccgcgagggcagcactcccccgtcctgccactatcgctgtctcccctcgctcccacgtctcactgctgtcccccctttcttgctcctgaccggcccgctcggtcacaagccggctgctccggttcctcttttcccagtcgctttgccctcccccacccacagcttgttgggtaaacagcggaacggactgggccggcgggatctggctggagcgcttgctccctcggtcccgcctcggattcgggcttgcgggtggcgaccctgcctgcgcaggtgcttggtctgggaggtggttttagcgagggaatggcagaaaatggaggcctaagcagaggaatctgtctacacagctgtactgtcacctgggggcagcctgaggacgccccttcagggaggtggcccttcagctcggcagctactttaggttgaagaacttctctctaccgagcagcccgtaaccccctttttctccctcactgctgcaggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctggg

SEQ ID NO: 1924 - DNA, 962 bp, Homo sapiens
  ENST00000496131
ggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcaggtaagtgtcagggtccttggacttttgtcagaaccagctgtgttggcgctgcctgtgtgtttgatctgacatactgtttctgacaagccaccttgtgggatgggatgttataggggaaagattgctggggacttactgggcaggaaggacggtttctttctcatttctttctcctttccactccttacccctaatctctaccactaccagcatcatcttctgtgaggctgtggccatctacggcatcatcatggcaattgtcattagcaacatggctgagcctttcagtgccacagaccccaaggccatcggccatcggaactaccatgcaggtgggtggatgggcgtatgaatgcaaaatgctgggacttcatgcctgcttccactctcccccatcccagcttgggccatcattttgatattctctcacctactttttctgctttgcagagtggggatggtgattggccccattagcccatatctcccccattcctggcttagcctcactgcacccctctctatcctcccaggctactccatgtttggggctggcctcaccgtaggcctgtctaacctcttctgtggagtctgcgtgggcatcgtgggcagtggggctgcc

SEQ ID NO: 1925 - DNA, 419 bp, Homo sapiens
  ENST00000498208
ggccgtgggtgaggccgggtcctggcgggcgggagcagcatcgcggccgagctggccgggtcggaactcggcggggaagtggcctgcggggaatactggccccccgcgcgctctgcacccgaggctctggggacttgcgcctgcgagggcctctgactccgacaaaggagacccggatttccagctgcttgaggaggggtgcgggcgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcag

SEQ ID NO: 1926 - DNA, 577 bp, Homo sapiens
  ENST00000532072
tgatgtggcatggtaagggagggcagggggaggattccccttgaagcttcttccctgcagcctctcttcttttctctggtctgagtccctcccccacaccactgcctgcctgggacatggacctttgggaaatacgcggtcagttgttgcctgtagaactggtggtggggttgaagggggtttgaggggttaagattttgtgctccgcttccctgctagagctgaactgctttcttctctgcttccacaacaggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcaggtaagtgtcagggtccttggacttttgtcagaaccagctgtgttggcgctgcctgtgtgtttgatctgacatactgtttctgacaagccaccttgtgggatgggatgttataggggaaagattgctggggacttactgggcaggaaggacggtttctttctc

SEQ ID NO: 1927 - DNA, 825 bp, Homo sapiens
  ENST00000498664
gagctgaactgctttcttctctgcttccacaacaggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtca

SEQ ID NO: 1928 - DNA, 5918 bp, Homo sapiens
  ENST00000514372
aatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactaatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaagctagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattacttaaaa

SEQ ID NO: 1929 - DNA, 8270 bp, Homo sapiens
  ENST00000381668
aagagctcgcccagctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtggcagtaggggagatagtgaaagtgaccaatggggaacatctcccagcagatctcatcagtctgtcctcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatggccatgtccctgaacctgaggattatggctgctctcctgatgaatggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactaatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaagctagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattacttaaaa

SEQ ID NO: 1930 - DNA, 8209 bp, Homo sapiens
  ENST00000264449
agctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtaaatgttggagatatagttataataaaaggcaaagagtatatacctgctgacactgtacttctctcatcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatgggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactaatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaagctagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattactt

SEQ ID NO: 1931 - DNA, 560 bp, Homo sapiens
  ENST00000511858
gtgaaaaaaatagtaataactaattttttattctaaaaattgccatgcttagaatatatgtagtcagtttttaaaagtgaataacactactgttgttttgtatttttttattttaattgtgttatactggctctgtgttgccatttgacttaaatataactgagtggggggtggtgaggagatcctactttttactgggagaaggattattggggaccaaactccttagggagaaaatggcctcaaaagtctgtctaaatacttgaaatttcattcgctatctgagaaaatgtgtaaaaagaatcactaggctacggatttctcgagcaatcttttgtttaagtctaactctctttggtggtcctgtgggcacactggggtctctgccgagttgataattcatttcacacatttgcacctgctctgcagcctgaccgagagggcgcaactgctcaagaacgtctttaagaagaaccacgtgaacttgtaccgctctgaatccttgcaacaaaatctgctccatgggtatgcgttctctcaagatgaaaatggaatcgttt

SEQ ID NO: 1932 - DNA, 920 bp, Homo sapiens
  ENST00000506602
agctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgtttgtgcgctttagatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggt

SEQ ID NO: 1933 - DNA, 469 bp, Homo sapiens
  ENST00000515872
gtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagaacactgacattcaagcaaataacaatttatacagtttatttacatagatttatcaagataccaggaatttaaagccactgccagcaataaatctgcttataaaaagttaattttataaaataagaatgtccaacttgtcgctttttaaatctaaattgacagcaataaagtaga

SEQ ID NO: 1934 - DNA, 324 bp, Homo sapiens
  ENST00000506713
cattttagaatgcttgaatatattttgtgatacaatcatgaaatctgtgatgtcttacttagaaatgcaggccaaattacatttaatttattgagggtttggagacataacactttactcataaagtacattaacaaatagatcagtgggctggtataaatgaactgggtttactctattttttacccccttcaggcagaactcacagtttggagatgaaaaaacatttagtgattcatcattgctggaaaatctccaaaataatcatccaactgcacctataatatgtgaatttcttacaatgatggcagtctgtcacacagc

SEQ ID NO: 1935 - DNA, 537 bp, Homo sapiens
  ENST00000504510
ttaaatataatgtgcaaatctattcatttgcattatcttgaagaccattactgattgttgtcaggaaattgcttttgggtccttctggctgaaaagctaatccgtgagttgtcatgcatgggttctgcctcacagcatcttgctgttagaatgaaaatcatcaagaagctaagtaactattactttgtctagaacgaaaggctttagtgagtctgagcatttaaataagttattattatgcttttcttcccgcactaaatctttgtgcttctcaactccaaactacagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgag

SEQ ID NO: 1936 - DNA, 326 bp, Homo sapiens
  ENST00000504024
aaacgacataaagctgataatgcagtgaacaagaaacaaacgcaagttttgagaaatggtgcttgggaaattgtccactgggaaaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggag

SEQ ID NO: 1937 - DNA, 2238 bp, Homo sapiens
  ENST00000510289
agctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcaggtaagaactaccaaagaatgccatgagaccagccagcagagcagagctggttaggtcaaaatgaaaatgcttgcaaagagctttcagtgcagtcagttaatatttgagagctccctgttggcagtgtgaataggctgtttccccatcttctctcccatagagaaatattcataagaatctggaaatagcgaggagcagaaagaataagcacccatcctctgccgatgctgcatagatattgaataatgaaagctgcttatgtgtaaatgcctctgtcctaaacctgttaatagagcgatgcgttactggttttggttagcaagttttaacattttagaagaggtctttgcaattctgcaccaagaattccttctggttatatagtctttaagtattggtttttgatagttgtgaagtttagtatggtgtggaggaatggagggctgtgcgaattacttcactgcactgttgtgttttcattccaacaataatgtaaaaagtatctgtgtaagcactggccacttatgcggcttctgggaccacataaacaccttcaataccaataaagtgtttctccagtggcagagttaactagatttgagaagtgcccacttaatatgtacaatttcaaattctagaggaacatttctcaatttgggtaatgtggcatgtgtctgctttaatctcctttctatttgataaacaagaggaagatctgggtgtttctaagacctaagtagtgatatcttactgatgtgggcatatctggtgtgtttagtgtggatttctagccatgttcctggagtggcagtgaagaaaattcaaacagaaccccagagatctccctgaaattatccaggaaaggcatctctgtttacagtgtctggtcaaattgctcaaattgctgatttcggggttcttttggcaagattttattttctagtcacacgttgtactctgtcttatggagggctggagccctttaactccaaagttgctcttctttgtaagctacttctagtaatgttaagcagaataattggccaaataggacaaaagattatgcaaaaaaaaaaaaatctgtggtattcatgctttaccatttatttaaccttttcactctttttcatttaggttaatgaccctttgcaatattctcccaatttgaaacagccggcaaatgttccttatctaactttttatatgttagtaacagaactttgtaagtgtgggtgctaattatggagaagttttatgctacttttcatttttgttttctagcactgcaaaatacaacataatcacattccttccaagatttctctactctcagttcagaagagctgctaattcattttttctctttattgcactgctgcaggtaaagtcacgtcataaaaccttgtcaaatgttcaggtactaataaatgttaagcccgtgaccaatcccctgaggtttatgtaaatgccgagagataagctggttttggtggacatttctggctcctgctgcaagcagtgttggaatccactaccttttccagccttttgattcatttttatcagcttattttgggtgttctataaatttgatgtggcaaggactgttcattttgggtggtaaaggggatgggacgttttcttaaaatgctaattttcatagtaaaagtatcaactctgaaccttagaatgcaagaagttaaatcttgtgcttctctttgtatttaaattagttgtagtcagaaaaagttttagtttattaaaaagtagcatattgaacatatgcttaaatttgaaaaaatattttcattgaacttgaaaataaaaaatttttaaaacaccacaaaacacaag

SEQ ID NO: 1938 - DNA, 5818 bp, Homo sapiens
  ENST00000283684
atgagtacagaaagagactcagaaacgacatttgacgaggattctcagcctaatgacgaagtggttccctacagtgatgatgaaacagaagatgaacttgatgaccaggggtctgctgttgaaccagaacaaaaccgagtcaacagggaagcagaggagaaccgggagccattcagaaaagaatgtacatggcaagtcaaagcaaacgatcgcaagtaccacgaacaacctcactttatgaacacaaaattcttgtgtattaaggagagtaaatatgcgaataatgcaattaaaacatacaagtacaacgcatttacctttataccaatgaatctgtttgagcagtttaagagagcagccaatttatatttcctggctcttcttatcttacaggcagttcctcaaatctctaccctggcttggtacaccacactagtgcccctgcttgtggtgctgggcgtcactgcaatcaaagacctggtggacgatgtggctcgccataaaatggataaggaaatcaacaataggacgtgtgaagtcattaaggatggcaggttcaaagttgctaagtggaaagaaattcaagttggagacgtcattcgtctgaaaaaaaatgattttgttccagctgacattctcctgctgtctagctctgagcctaacagcctctgctatgtggaaacagcagaactggatggagaaaccaatttaaaatttaagatgtcacttgaaatcacagaccagtacctccaaagagaagatacattggctacatttgatggttttattgaatgtgaagaacccaataacagactagataagtttacaggaacactattttggagaaacacaagttttcctttggatgctgataaaattttgttacgtggctgtgtaattaggaacaccgatttctgccacggcttagtcatttttgcaggtgctgacactaaaataatgaagaatagtgggaaaaccagatttaaaagaactaaaattgattacttgatgaactacatggtttacacgatctttgttgttcttattctgctttctgctggtcttgccatcggccatgcttattgggaagcacaggtgggcaattcctcttggtacctctatgatggagaagacgatacaccctcctaccgtggattcctcattttctggggctatatcattgttctcaacaccatggtacccatctctctctatgtcagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattgtaagaaccccagaaggcaatatcaagctttactgtaaaggtgctgacactgttatttatgaacggttacatcgaatgaatcctactaagcaagaaacacaggatgccctggatatctttgcaaatgaaactcttagaaccctatgcctttgctacaaggaaattgaagaaaaagaatttacagaatggaataaaaagtttatggctgccagtgtggcctccaccaaccgggacgaagctctggataaagtatatgaggagattgaaaaagacttaattctcctgggagctacagctattgaagacaagctacaggatggagttccagaaaccatttcaaaacttgcaaaagctgacattaagatctgggtgcttactggagacaaaaaggaaactgctgaaaatataggatttgcttgtgaacttctgactgaagacaccaccatctgctatggggaggatattaattctcttcttcatgcaaggatggaaaaccagaggaatagaggtggcgtctacgcaaagtttgcacctcctgtgcaggaatctttttttccacccggtggaaaccgtgccttaatcatcactggttcttggttgaatgaaattcttctcgagaaaaagaccaagagaaataagattctgaagctgaagttcccaagaacagaagaagaaagacggatgcggacccaaagtaaaaggaggctagaagctaagaaagagcagcggcagaaaaactttgtggacctggcctgcgagtgcagcgcagtcatctgctgccgcgtcacccccaagcagaaggccatggtggtggacctggtgaagaggtacaagaaagccatcacgctggccatcggagatggggccaatgacgtgaacatgatcaaaactgcccacattggcgttggaataagtggacaagaaggaatgcaagctgtcatgtcgagtgactattcctttgctcagttccgatatctgcagaggctactgctggtgcatggccgatggtcttacataaggatgtgcaagttcctacgatacttcttttacaaaaactttgcctttactttggttcatttctggtactccttcttcaatggctactctgcgcagactgcatacgaggattggttcatcaccctctacaacgtgctgtacaccagcctgcccgtgctcctcatggggctgctcgaccaggatgtgagtgacaaactgagcctccgattccctgggttatacatagtgggacaaagagacttactattcaactataagagattctttgtaagcttgttgcatggggtcctaacatcgatgatcctcttcttcatacctcttggagcttatctgcaaaccgtagggcaggatggagaggcaccttccgactaccagtcttttgccgtcaccattgcctctgctcttgtaataacagtcaatttccagattggcttggatacttcttattggacttttgtgaatgctttttcaatttttggaagcattgcactttattttggcatcatgtttgactttcatagtgctggaatacatgttctctttccatctgcatttcaatttacaggcacagcttcaaacgctctgagacagccatacatttggttaactatcatcctggctgttgctgtgtgcttactacccgtcgttgccattcgattcctgtcaatgaccatctggccatcagaaagtgataagatccagaagcatcgcaagcggttgaaggcggaggagcagtggcagcgacggcagcaggtgttccgccggggcgtgtcaacgcggcgctcggcctacgccttctcgcaccagcggggctacgcggacctcatctcctccgggcgcagcatccgcaagaagcgctcgccgcttgatgccatcgtggcggatggcaccgcggagtacaggcgcaccggggacagctgatcccttacccccaggctgggatgcggccacaaagcacgtctatttttttatgaaagactctcaggactttgtgtgtgtgtgtgaattgcattcatcacaaagatattgaagacaataaataatctttataacaaactccttgggttggactattaaacaatagcagagccaagaaataggacttttaaaagtcctattattcggccgggcgtggtggctcaggtctgtaatcccagcactttaggaggctgaggaggggagatcacctgaggccaggagttcgagaccagcccagccaacatggtgaaaccctgtctctaccataaattaaaaattagccgggcttggtggtgggcacccgtaatcccacctatttgagaagctgaagcagaagaatcgcttgaacctgggagatggaggttacagtgagccgagattgcgccactgcactccagcctgggtgacagagcaagactctgtcttaagaaaaatttaaaaataggccgggcatggtggctcatgcctgtcatcctagcactttgggaggccaaggcaggtggatcacttgaggtcaggagaccagcccggccaacatggtgaaaccccatctctactaaaaatacaaaaattagctggaaatcgcttgaacctgggaggtggaggttccagtgagccgagatcgtggcactgcactccaacctgagcaacagagtgagacaccagctcaaaaaaaattttttaataataataaaagtcctattattcaactggttatgtacattatggttgaaagggaacgttttaatccagtctcaatccagggcaatagaattacaaagcatgttgtatttcagttcaaatggtattgtattataaaattacagttacattttcctttcggtgatcttcagcataatttcccagaggcccctttttcctccctataggccatcttattaacagattttaaaatttatagtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataaatatttatgggcttaaaaagggggtttttaaaaactgaggatatcagtaataaattgcagaatattttgcaaagctttcttttggaaagcaaacttttgtgcctgcctatatgcaaagtattttatcagggacttgaacaaagacctcactctttttcacttgtcttatgtcgagagaaaaggttattggcagccacattcctaagactggggaatggtgtgtccttttaaatttgaagataactttaggtaattatggaaactcctcaaagaggagaaagtaatttttttccagacatttttctcattctgtgtctttcacacactagtttccatagttcgagaattctgttttttaccattgggctgtgaatgttcacaatatcagtcctgttgaattcctatgaggtaatcacaatgtgtatatgttcattttctaggtatgataaaagaatgtatggctttttattctgtggaagtaaaatcctgaacgtttacaacttttccttaacttgtaaataaaaaattgtaagttttttctttttttacagaaaacttagcttgtgtaattctgttagtttcagatttctctcctgtttttgcaaattgtgggaaagattgacaatgcaaatgtgtcaaagacatactgttgggtgcaatattaacaattttaaatgcaaatttctttggataaattatttctatattctgtaaatctgagatttaatgtatattttgtttaaaaaaatgatttagtaaaatctttgaaaagtatgatcttctaaagtatttaaa

SEQ ID NO: 1939 - DNA, 489 bp, Homo sapiens
  ENST00000588255
ggggattgggtttcaacatatgaatttggagggggattctaacattcagaccatagcagtaaataagcagcttgctctcgtctgtacaatgagaataaaatctctactacttgccactcgtatccgagctctctacggaaaataatcttctgtcttcctagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatc

SEQ ID NO: 1940 - DNA, 540 bp, Homo sapiens
  ENST00000589147
gtgctaaagtaaaccattaaaagcacatgcatttgcaaattaccaccaaatagaatggattcaagagtaccttataatgtacatggcaagtcaaagcaaacgatcgcaagtaccacgaacaacctcactttatgaacacaaaattcttgtgtattaaggagagtaaatatgcgaataatgcaattaaaacatacaagtacaacgcatttacctttataccaatgaatctgtttgagcagtttaagagagcagccaatttatatttcctggctcttcttatcttacaggcagttcctcaaatctctaccctggcttggtacaccacactagtgcccctgcttgtggtgctgggcgtcactgcaatcaaagacctggtggacgatgtggctcgccataaaatggataaggaaatcaacaataggacgtgtgaagtcattaaggatggcaggttcaaagttgctaagtggaaagaaattcaagttggagacgtcattcgtctgaaaaaaaatgattttgttccagctgacattctcctgctgt

SEQ ID NO: 1941 - DNA, 532 bp, Homo sapiens
  ENST00000591728
cagggctggggccgggcgggcggcggcagcggccaggtgcgcagcgagcgctccgagcggcgcgcaccaggcggatgccccagccggggcccagcgaacgccaggtagttccaatttgccagcagaatgagtacagaaagagactcagaaacgacatttgacgaggattctcagcctaatgacgaagtggttccctacagtgatgatgaaacagaagatgaacttgatgaccaggggtctgctgttgaaccagaacaaaaccgagtcaacagggaagcagaggagaaccgggagccattcagaaaagaataatgcaattaaaacatacaagtacaacgcatttacctttataccaatgaatctgtttgagcagtttaagagagcagccaatttatatttcctggctcttcttatcttacaggcagttcctcaaatctctaccctggcttggtacaccacactagtgcccctgcttgtggtgctgggcgtcactgcaatcaaagacctggtggacgatgtggctcgccataaa

SEQ ID NO: 1942 - DNA, 527 bp, Homo sapiens
  ENST00000585322
gactccatctcaaaaaataaagcagcaaggttcaggaactcaggcttattttaaaaaaaagaaaatgaagaagaagaaagaaggaaaaggggctggatatggtagctcatgcctgtaatcccagtattttgtgaggccaaggagggaggattgcttgacctcaggagttcaagagcatcctgagcaaactagcaagacctcatctctactaaaaaccaaaaaaattagctgggtgtgatggtgcacacctttagtctcagctacttaggaggctgaggcaggaggatcacttgagcctgggagattgaggctgcagtgagcttgatcaccccagtgtactccagcctaggtgacagagcaagaacttgaatcaacaaccaaaaaaaaaaaaaaaaaggaagaaaaaagaagcaaaccacctcatgtgtatgccacactcacaggaaattaaagatgtgaacaccaaaagcaggtagttccaatttgccagcagaatgagtacagaaagagactcagaaacgacattt

SEQ ID NO: 1943 - DNA, 1701 bp, Homo sapiens
  ENST00000616894
agttggcgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccgggatttcgccagggaataaaaatgttcttcaaatgtttcttgaggatagaagattgatagttgggggaagaaatgcagaagcaaatatagtatcaaaagtggtacttcagttctcttagcattgattccagtcttctgtttccatttgaaaagaataaagcactcagaataacaagccattccttccttacacaggttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatgtagaaattggtaaccagagaatttttcaccagaaatattataaatatccttgaatcagcaatttattatggaatttatttatcctacaacgtatccaaaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctttaataaaatcttcatatgaattta

SEQ ID NO: 1944 - DNA, 1818 bp, Homo sapiens
  ENST00000609571
agttggcgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctttaataaaatcttcatatgaatttagtcaaaa

SEQ ID NO: 1945 - DNA, 932 bp, Homo sapiens
  ENST00000526946
cgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgat

SEQ ID NO: 1946 - DNA, 1583 bp, Homo sapiens
  ENST00000527407
cgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaagaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgat

SEQ ID NO: 1947 - DNA, 8479 bp, Homo sapiens
  ENST00000355044
ggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttggactattttgaaagaaagtgggtttgccagataccttcattcagctgttcttatcaatggagctatgcttatttttggaggaaatacccataatgacacttccttgagtaacggtgcaaaatgtttttctgccgatttcctggcatatgacatagcttgtgatgaatggaaaatactaccaaaaccaaatcttcatagagatgtcaacagatttggacactctgcagtagtcattaacgggtccatgtatatatttgggggattttctagtgtactccttaatgatatccttgtatacaagcctccaaattgcaaggctttcagagatgaagaactttgtaaaaatgctggtccagggataaaatgtgtttggaataaaaatcactgtgaatcttgggaatctgggaatactaataatattcttagagcaaagtgccctcctaaaacagctgcttctgatgacagatgttacagatatgcagattgtgccagctgtactgccaatacaaatgggtgccaatggtgtgatgacaagaaatgcatttcggcaaatagtaactgcagtatgtctgtcaagaactacaccaaatgtcatgtgagaaatgagcagatttgtaacaaacttaccagctgtaaaagctgttcactaaacttgaattgccagtgggatcagagacagcaagaatgccaggctttaccagctcatctttgtggagaaggatggagtcatattggggatgcttgtcttagagtcaattccagtagagaaaactatgacaatgcaaaactttattgctataatcttagtggaaatcttgcttcattaacaacctcaaaagaagtagaatttgttctggatgaaatacagaagtatacacaacagaaagtatcaccttgggtaggcttgcgcaagatcaatatatcctattggggatgggaagacatgtctccttttacaaacacaacactacagtggcttcctggcgaacccaatgattctgggttttgtgcatatctggaaagggctgcagtggcaggcttaaaagctaatccttgtacatctatggcaaatggccttgtctgtgaaaaacctgttgttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccagcttgccagtgtaatggacatagcacttgcatcaataataatgtgtgcgaacagtgtaaaaatctcaccacaggaaagcagtgtcaagattgtatgccaggttattatggagatccaaccaatggtggacagtgcacagcttgtacatgcagtggccatgcaaatatctgtcatctgcacacaggaaaatgtttctgcacaactaaaggaataaaaggtgaccaatgccaattatgtgactctgaaaatcgctatgttggtaatccacttagaggaacatgttattacagccttttgattgattatcaatttaccttcagcttattacaggaagatgatcgccaccatactgccataaactttatagcaaacccagaacagtcgaacaaaaatctggatatatcaattaatgcatcaaacaactttaatctcaacattacgtggtctgtcggttcaacagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacagattgcattctcacaacacaatacaatcatggaccttgtgcagttttttgtcaccttcttcagttgtttcctatccttattgctggtggctgctgtggtatggaagatcaaacaaacttgttgggcttctcgacggagagagcaactgcttcgagaacgacagcagatggccagccgtccctttgcttctgttgatgtagctctggaagtgggagctgaacaaacagagtttctgcgagggccattagagggggcacccaagccaattgccattgaaccatgtgctgggaacagagctgctgttctgactgtgtttctttgtctaccacgaggatcatcaggtgcccctccccctgggcagtcaggccttgcaattgccagtgccctaatagatatttcacaacagaaagcttcagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagtattgatggtcacaggtgataaagtcagtttttaccactatcttaggcttattatagctaacattaaattactctggaaaaagatgtatattgtttcttaatgaagatgaaaaatatgtaattcatataaatcaactgtttatatcccaagacttgaaagaaagacattttttaatgcctgaatgatgagaattgtacagtttttgcctcataagcaaacttgaatcacctgtgtatgaacagggaatgaacacattgcaatggctttaaatgctcttttatctcgttgtaaaggtaaggcaagattttgatgtagtaggatgtaggtaatgtatttaaatatttcatatgaccatatcgtgtccaaactcagtctgagaatgtgacagctttccgcctaactagaatgcagaccagaatgagttcaactcattctgtgcaacttcacagggggtttattagaatgctcagtgtagaggacattcctgtcatccatgccaactacctaactcgttatcagagctgatagagcatggaaaagtctgtccagcgatcagttgttcccctccttccaaaaacagcctccaataccacaacctgaaaagagccgaaatggttattttacagcatacaagcttctgctccagtatgataatttttaattgcctaagaatcattggatcagacctaaatgatccatctgcatttttataagaatggatctttctttgcccttcctctcctagctgctagattttaactaccttttacaaatgttacaaaatgtattttagaggcgacatctctcaagatgacctgagttccttcctgccaactgttccacctagaatacaagtagagaagagcactggctggcaagcatcaacaggagtcttcttcccaacacgagcgcatccatgtcctgagaaaaagtctgtggtttagaaaatatgtccatggttgcccacagtcagcacactcttagtgactcaaaattctgaattatggcagaaaggaaaaataaaacatacttcacattagaacacagaatcatttacatcctaatactgaccacagttcactaaagctcagtagcattaacagatatagtttggaattgcagtttcctcacttcagggtgacaagatatgtataacagtgacagaaatctccaaagctgctgtatatgatatagctttgttaaatatgaaggtcctttaaatacaattgatgtttagtactatatatgtacttttcacattctttggatttctggaaggttatgacactttactgtttacagctaatgcatagttacttgcatgccatggttgtacagtagcagactatgaccctattgtgatattaagtgtttatttcataatgccatttatacatagctgaatttgatgaggattgaatgtcatatataagaggaatgatcatacaatatgtagttgcatcttatataagatttctaggttgcatctaaccatgactatgtcattattttgataattaggcatttatgaattatagtatatattcctcatgttggcatgataattttgctattttccatgcattaaaaataagacaaattcttagagtaattttagtaattttatctataatctgtggggtttttttggagggggaggccactggttgtttctacttccctgtgatattttctctctcattaaaggaatgagctaagtttgtaaatatctcctaaaaacaatcaagtaattttattagcttcttttggaccctctaaatattgacttctctcatgaaaaaataaattgatgaaactaatgattacaaagatataatcattttttaaaaagtgattgcccaatgtatttctctaacaattgtcacaagagaaagcataacaataaaaatacaaaaacatacagatttagatgtaaaatctatataagctatatttttagggaggctaagcagatagtattactgtggaagaattatcaagttttattcacctcaaatcccactgggttcttaaaacttgaaaattcaaattgtagagaattatgagacacaatgtgatgtttagttaaagtcatgctatacctttctgggccacatattgctaactctgtggctaattatgcaattaattctcaacgtatcaaagcttttcactggcagtaaattctttgccctcaggtgaagtggattgaaaagacatcaaggatcaaggataatcactttgaatctgttggtttttccccctacattccagacactttaaatttggatgctttcattttttttaaatcaaaccacacaaatatgcagatactttcccagaatttcgcagttaaatggctgatcctcttgaaaactaaccttaatggaattctaaacatttcagtttagaatgactttgaaaaattccttagatttttaggatgttttattctgccaagtatgaaaaaaaaatggttaaatacaatggagttttaaaaattaacctggggattctatttgaactagaaaattcctattggaaaagaatttgcacatacttacagattcagctaataaattttaagaggattaggattctcataattctttaaatgaaaatttgttttagtgatacacagagatgccgtatactatagtgttatgttcagtaggaaaacttcaaatagttcgtatttaaaaaggtaattgatccttgctgtacttcccaacatctcatcttcttttagctgcagtaagatagaggtgactgtatggctacagttcatggtataaggtcatttagggtgcacactggcacacaggctggaaaacgggcactggacccagctttcaggtgtgtggtgctgggtaagtttcacctttgaagcctcagccttccatctgtaaagggcggtaatggtgcccacctttcgaggcattgcgaggctagatggtaacacacagaaagctcccacagtgggaccttgatgcagcgtagctggtattaacaaccgtggggacaccaggccactctttttctaccagttgttttatgaatccacctattaattttcatccatcttttggtcgtaggtaaaggtcaatcaggtttttcaaaaagactccctgaataacttaagttcctgtatttctaagatatagggatttctacaaaacgactttgacatttagtcaataaagacttaaactcttcttaaatctatagttttaggagagtttttcttaaaattactgactgatgacattgagacaagagcatcaatgatcacctttcacgtacaaactaggcaagacagggtcagtgcttacattttgtggttatacatgatacatcttttctcagtgaacataaaactatgatttgaaaggtgtcttatatttaaaaaagattgtaaaatgaaaactgaccaaatgaactaattctacccacctatggtctttttaaatgtcgagtttcaaaacccatttgccgtatactagagtgagcttggaaacttacctgattacaggaattgcttgggttcaggcagattcccactttcacctctagagatttagattcagaaacactggggtaggccctggagagcagtactcttaacaagctcctcagtgcttcttaccattaggcaaattagggaaacactgcattgggtcaaagtgctgcctttaatcgaccattagagggagttctctaaataacaaagttattactctaattcaaaatgctttaaagaattttccaaggaatacaagccatctggttggtgttagttatagcagtgatttcattagagtgtacatttaacattttagttttatcaaaattttttgaaattaagaattagaaccagagctcctatcagtatatatgtacacaggtgtgcatgccagtgttcaaaagattgtgtaaaagttcaagcccgttttagaaagccaacattttatgttataatatgctgttaatcaggactttattaaataaaaacattggctcttccaacccccac

SEQ ID NO: 1948 - DNA, 311 bp, Homo sapiens
  ENST00000524503
atatatggttatacaagcagcatacaggaataccatatctcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttgggtgcttggtctccttgtggtgaagcagttttgaaggtttcatggtttcattggatggctggttgcaacgtattgtacaaagtggac

SEQ ID NO: 1949 - DNA, 648 bp, Homo sapiens
  ENST00000526373
ctgtgaaaaacctgttgttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccagcttgtacatgcagtggccatgcaaatatctgtcatctgcacacaggaaaatgtttctgcacaactaaaggaataaaaggtgaccaatgccaattatgtgactctgaaaatcgctatgttggtaatccacttagaggaacatgttattacagccttttgattgattatcaatttaccttcagcttattacaggaagatgatcgccaccatactgccataaactt

SEQ ID NO: 1950 - DNA, 569 bp, Homo sapiens
  ENST00000534530
tgactctaatgcctatatcatctcttttccatatggacaatgtctagagtggcaaactgccacctgctcccctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccagcttgtacatgcagtggccatgcaaatatctgtcatctgcacacaggaaaatgtttctgcacaactaaaggaataaaaggtgaccaatgccaattatgtgactctgaaaatcgctatgttggtaatccacttagaggaacatgttattattgcattctcacaacacaatacaatcatggaccttgtgcagttttttgtcaccttcttcagttgtttcctatccttattgctggtggctgctgtggtatggaagatcaaacaaacttgttgggcttctcga

SEQ ID NO: 1951 - DNA, 768 bp, Homo sapiens
  ENST00000424738
tcgaacaaaaatctggatatatcaattaatgcatcaaacaactttaatctcaacattacgtggtctgtcggttcaacagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacagattgcattctcacaacacaatacaatcatggaccttgtgcagttttttgtcaccttcttcagttgtttcctatccttattgctggtggctgctgtggtatggaagatcaaacaaacttgttgggcttctcgacggagagagacagagtcacactcttgtcacccaggctggcgtgcagtgtggggatctcagctcactgcaacctccgcatcctgggtcaagcaattctccattacaggcgcccactaccacgctcagctaatttttgtattttttagtagagatggggtttcaccatgttggccagactggacctcaggcgatctgcccacctcggcctcctaaagtgctgggattacaggcgtgagccaccgcgccgggcctctatgtgaactctttaaatttagacattttcaacaacattgctgttcatttctgtagtagattaaggtgtgttcatataactgaacttctaaactcgtgatatatagattatttttggcctaaacagtgttttaaaaatttaaaaag

SEQ ID NO: 1952 - DNA, 529 bp, Homo sapiens
  ENST00000449616
tcaggaatcagtatttcatttgatttttaaactgccatcaaggctaagacaaagcccttatgagataaaggccaaactcctcaggatagctctacagggctcttccaaatcagatcccatcctgaccttccagcttcaccttccattgcttctactgcatctcaccctccccaaaccagatctgcttgccaggcgccagacatactgaagacaggacatgacttcaggccttgcaattgccagtgccctaatagatatttcacaacagaaagcttcagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagt

SEQ ID NO: 1953 - DNA, 10602 bp, Homo sapiens
  ENST00000244769
ctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagttttacctcacaaaaactactacaagcaccaagctccctgatggaaaggagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 1954 - DNA, 892 bp, Homo sapiens
  ENST00000483591
aggaggagggatcacttgagttgagctctgctgactagattgcatttctgtgggaagagatggatggagcatgaggaaggccatgtgtgtgtctgggacataacaagccaatgcacgcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttatctgatgcacaaaggaaaataataatacaaaacccataacctattcattgtattgttgcggtagatcgagctacatgctgcacagcaaaagaccttctttgcacttctttcaagcagaattattgctgtatattcactctgaactgagagatcattgcaaaaaaaaaaaagaagaagaagaagagaagaaaagaaaaaagaaataggttaagcaaattttgtggtggtgcttatgtgtgcacagacatgcatgaggcctccgcatcttccaaacttggaaagcatattttaacagcacaaatatatctacatgtttgatc

SEQ ID NO: 1955 - DNA, 1569 bp, Homo sapiens
  ENST00000473388
atttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttgtaagttaacaaccaagaacaatatgtgtagtggcttgccttgtaggattcatgaatcacttgatgtaaccgagccaggtgttgaaggggtattagcatgagctctaggtgatcgtccaattaatttctttttttaattggaagggaatttaattttttaagggaagaggtcctgtttgtatttgctggaacttgcctttctctcggcttctatggcatgctgcaaactatctacttcaggaataaaaggatggaatacagtgattctttcattgtaggaacaccttttctactggtacagtcaaatagtatcagatttagagcagcccctttaaactgggctgttgcagttcttttaggttggtgagtagggggtaaaattctccaggctaaggattagcaatcagagtttccatccagcaattattcttctgtatgtgcagttgatgaaaatgacatttttctctctggcttgtaaaatcttgaggtatgcaagttacaagcagttatgtttggtgcttcccttacttaaaatgagctgatttactggttttgatcagttactggcttgggattttgagattagtaaagtttgttcccacatgtcacctgatggccgccttgcatgagaagttttagtgtcaggtaatggaagagatgacatagtgtgacttcagggagcccttccactaggaaataatgcaaaggtgctcagccctcctactttctagagaatttaccttgttgctggactgtgtcacaaaacacagttaggagattttgaccaggaaagaaaatagctacatgaaacccaggatggcctatgaatacctctga

SEQ ID NO: 1956 - DNA, 853 bp, Homo sapiens
  ENST00000495178
ctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttgaatatttaagagaaaacctttttggccgctttgataatgataatttttgtctattgaatggtgatgctgtgattttcaggatgtatgtatcatggaaactggtagagaaagaaagaactgagatcatgctgaagtatactggggcccaccaagaggtagagctgagtgcaccaattgtcaccaaaatggcaacccgtaaaagagaaccattcttaagaaagagtcatgtaccatcaagcggggatttccagaagcctctgatagtaacagttctcccttccattcctttcctctctactttcaagatgcgatgatgacaaaaagactgacttgtcaaaaaaaccatgaaattccatacaaatgggcaagctgacatatagcagcttcggaaatttccacaatcgctcctctgagttgcctcaaggagaagaaaagtgagagaaaggaagggtacctttgcccccattaaggcacatgtagcatcctggaagctttgaaattacctgtccccaaagttattagaattatgtcattttttggttgttatattatgaaagcctccccacccctaaaagtttgtctataataatttttttgatcaggatttttacttcttaaattaatattaaagcattttaatgtttctagaaa

SEQ ID NO: 1957 - DNA, 744 bp, Homo sapiens
  ENST00000483954
ctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacaaacatcagtgctctatcctcatgtccttctaagaatcaaaagttttaacctcacagaatccagcgtgtggcttgtgagtgagactcctttttccatgtgataaccggtctgctttggggaggcaaaagaatcttaccgacacgtacatattttaggatgggctctgagccaattcatcaagccaactcctcactttgaaacaagaaagtgaagaggatgtttcatgattgtggaatacctgccagaggaagaatctaccgaagttcagtcaactattaattggaaaggaggcagcagactgaggagatagagaatctttgctctcaggtggatggaggttggagtcctcaatctgtcacttgtgggtacattatgtagctccttcacctccatttctttatttattagaaggcgggtaataaaagtgtccactgcctaggatggttctagggcttagaggagataatgaaactcaagggcttaacatgtgaatgttagctattatcattgcatgtgtccattaacacccaaagataaccagtgttgtttagtagttctttgcgtattttctttctaaatagataa

SEQ ID NO: 1958 - DNA, 3362 bp, Homo sapiens
  ENST00000467008
gtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcaggtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttctgaaacagattaccttttttcttctcctcatgatggctccctgagttgcttccaattgttgaaattccataattacccacaaatatggatgtgcccttctaagggtcttgccatgtcaaccagcccagctgaaagctaatagccagtgttagcggtttaaggaactgagcttcagaattgagagcccccagcaaaggaagttctgtttttattctccatttctactctcctcaaggagaaattaggtgtttattgttttgttttgttttttaaattcccagatcattctggcattggtcctggattcgctgcaaatgtaatttttagcaacatctattactcctgaaatattttggctcttcgtggcctgtatgattcagtagactctgaggttttccaagtacattaaggacttaaatacagaatgtcttaaaattttagggctattgatcaagagaaagcttctcgaggaataaagttctgttaggttttagccctattctgctttcaaaattcttaactggatgccgtctattttgttttctttctgtgtttataactaatttgctacttgggtttattgttttcttacttagaaactacttttttttttgttttgtaaatgcacagcacttaaaaatataaaacagttccaaacagttccaacctgttcattgtttataccttgaccatcttttctgtcttattgctgaaccatcgcttctctttctacttctcttctgggatttcatcttgctcagctaaaattctagtgtgttattctgaatattatggctggagtttcctgaccaacttcttgcatctgagtccatttcctgtgcttaaggctgctggcattccattcactgctcctagtcaaaactgaaacttctcctgctaatgagattaggccttacaacactattaatttcttcctctctatttcttgctccattgttatttctcagagatgaaaatctatttgtcattatgagattcattttggcatcacttactaaagttcccttggatttttctgttcttcatacaccctacagcttcaaactgcaacagtcatcaactggtctttgacaaattagttgtctctacacatggtttacaatattacactagctgtttaaaaataattaagcttctttctgtgttctttgctgtgggtcaggaactttacttcctttgccatgcaacacagaagttaatcacaaatgggtcctctgaaccaaataattaaaaatagagcaaagtttctgaaccaggcggttggcagaaacgtctgtacttccatctgtgcatggttaggaaaatatttcacgatatttaaatagcatcagctttgctctcttttgtgtgagagtgtgtctgtgtgtctatgcgtaattcattgctttgaaggtttgtttgactgttagataatcatataaaaaaagttactggcaaggaaacaggaaagcaaatccaggtgttttgtgcatacattctttatttaccagtctctgtgaaggagcaatgatcttgcttttgcttttctctctgactgaaagtttttgccttgttatgtgctgcagaaaactaaataacattgcattttgactttgaaa

SEQ ID NO: 1959 - DNA, 1648 bp, Homo sapiens
  ENST00000498374
ggaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttctgaaa

SEQ ID NO: 1960 - DNA, 647 bp, Homo sapiens
  ENST00000492857
atcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagttttacctcacaaaaactactacaagcaccaagctccctgatggaaaggagcatcgtgcatcaagtcaccagggtggtccattcaagctgcagatttgtttgtcatccttgtacagcaatctcctcctccactgccactacagggaagtgcatcacatgtcaggtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagct

SEQ ID NO: 1961 - DNA, 568 bp, Homo sapiens
  ENST00000479680
agagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcaggtgagagttttgcgatgctctctgttttccatctgaggataaagtcctgacctggaaaattgcctcctagccatgctcccttactttgttggctgttgaatatcattttctttgcaaactctgtttgggcatagtgtgggaagttgagaaattgccaagattgttttttaaaacttcgattaaagtatctatctatttggtttaatctatatgttcatgaagactttcatttgactttgcgatgattgataattgccaattggggcttgaa

SEQ ID NO: 1962 - DNA, 10587 bp, Homo sapiens
  ENST00000436367
gaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 1963 - DNA, 3022 bp, Homo sapiens
  ENST00000463678
ctattcgatctacaggggagcggagtcgcttcgtggccgccagcccgggaaggggcgccagccagctggcggacgcacggcttagaggggcgtctgggcagagaggtttggggctggggagagatgcagtgagcttgggagagtggactggtagcacaaataatgtgtgcataagggttagaagaggaggtcctggagctttggtcttctcttttccccctgcaattgtgcatttcggagggactcttgctgcaagctcggtaggcaatagcatccgctccaagactacacttcccagaaggctgtgagtgggtggggggggggggggcgcggggaacaggcaacctgtgttgcgcttgcgcaaagactgcgctggaaaggcaggtggggaggaggggaggcgtgcccgcgacggggcgagggggagggggccgcgcggcggcggcgccagggcgggcgcgcgtccgcggcggtgatggcggtgcgtgaacgcgcggcggcagcaatggccgctctggagcggcgggtgccgagtctcgatgacttcgcgggacagagctggagctcgtgggtggagcgggccgacctgcccgcggctgacgaaactgaggtacaagggcaacccctgcccaaaggccctctaagaaggggagggacttgcatagctgaccaaggagactttgaagatgctcaaggaccaaagacagcagtttctctgctctgtgaccatcctatcagtgcaggacctgagaagctgggtgtaactttgacaatgctatggggctgagctggaggagagtagcaaaaacacgaagaagttggatgccatgaccctcattaaagaagacatgtccatcttcgggcactgccctgcccatgatgacttctacttggttgtgtgtaaccactgcagccaagtggtgaagcctcaagctttccagaagcactgcgaaagaagacatgggcccctcagcaagctttatggccgggccccacccccacctccagcccctgccagctctcagaaatgccatgtagtgaatgggcagggcccagcttgtagggccccaggttccacgaaaacctcctccagggagaagggccaggggtcccggagccgtggccaccagcctcctgagaagacccagaaggacaacctctgccttttcgtgcctgtggtgaatctggagaagatgtccagtctcccgaagcctgatggacatggaatcagggtggccccaccctctgcttttctcagccagccagggggcctcaccaaggactcccctggaaaacctcccatggctcccccttctaaagaacctcctggcagagagaacatcgagatcatccccagtgaggggtccagtcactgggctgaaggcagccctcctgaaaaggagcccagtgggaccaggctgccccctaaaacccaccggaagatggctcggaaggagtgcgacctcaacaggcagtgtggggtaataaatccagagaccaaaaagatctgtacccgcctgttgacctgcaagatccactcagtacaccagcgccgggaagtccagggccgggccaaggactttgacgtgctggtggcagagctgaaggccaactcccgcaaaggggagtctcccaaggagaagagcccagggcgcaaggagcaagttctcgagcgcccctcccaggagctcccctcctcagtccaggttgtagcagcggtggctgctcccagcagcaccttctctgttcgtgccaagcagacctacccatactgtgcactgcccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttt

SEQ ID NO: 1964 - DNA, 2318 bp, Homo sapiens
  ENST00000369870
gcgtccgcggcggtgatggcggtgcgtgaacgcgcggcggcagcaatggccgctctggagcggcgggtgccgagtctcgatgacttcgcgggacagagctggagctcgtgggtggagcgggccgacctgcccgcggctgacggggctgagctggaggagagtagcaaaaacacgaagaagttggatgccatgaccctcattaaagaagacatgtccatcttcgggcactgccctgcccatgatgacttctacttggttgtgtgtaaccactgcagccaagtggtgaagcctcaagctttccagaagcactgcgaaagaagacatgggcccctcagcaagctttatggccgggccccacccccacctccagcccctgccagctctcagaaatgccatgtagtgaatgggcagggcccagcttgtagggccccaggttccacgaaaacctcctccagggagaagggccaggggtcccggagccgtggccaccagcctcctgagaagacccagaaggacaacctctgccagccagggggcctcaccaaggactcccctggaaaacctcccatggctcccccttctaaagaacctcctggcagagagaacatcgagatcatccccagtgaggggtccagtcactgggctgaaggcagccctcctgaaaaggagcccagtgggaccaggctgccccctaaaacccaccggaagatggctcggaaggagtgcgacctcaacaggcagtgtggggtaataaatccagagaccaaaaagatctgtacccgcctgttgacctgcaagatccactcagtacaccagcgccgggaagtccagggccgggccaaggactttgacgtgctggtggcagagctgaaggccaactcccgcaaaggggagtctcccaaggagaagagcccagggcgcaaggagcaagttctcgagcgcccctcccaggagctcccctcctcagtccaggttgtagcagcggtggctgctcccagcagcaccttctctgttcgtgccaagcagacctacccatactgtgcactgcccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctcaa

SEQ ID NO: 1965 - DNA, 4375 bp, Homo sapiens
  ENST00000497545
ggggacctgggagagtatctatttgggatgccacatagtagcagaaaggacccatcgagaaatctcaagaagagactcagggacttatagaaacattggttaaggacggtttcccctttaaatggggaagcaggcccagaaaagagatgatacttacccacaatcacccaactagttagcagtggaaccctaaactgcaccttgaagtgaagggtcccataagaaaggtggatggattcttcttagtggggccatcttagtccagatgcagcaggtgaaggaagatgggcatttgagaatggacccactgaaaggttccccaagtggtcctagcaccaggagcttgtcacggagtgtgggcttcatactgttgagctgcaggccctgcttggggcttctggaaaggggacaacctctgggttgtcttctgggaagaacagtctctggtaaggagaggctggagactctctaaaactggccctgacccttctgagctgtgtttctcctctaggggctgagctggaggagagtagcaaaaacacgaagaagttggatgccatgaccctcattaaagaaggtgggagtcgacacacattagggctgggacccagggcagacaggaccacgctccacttttccaccacactacagaaggaggtggctgcttgaagcagctgtctggggaccctcattttgataggtccgagtcggccggttgttctggctcctgtgacctgtcgttggagatcataatcataggtgattgcccactcacctgaaagcgtataccctttgggactgcttagatcgaactctggaagctggaagcattcagcatggagcttgttatatcagcggggaggtgaagtgccttctgagtgtggggtgggagtgctctccgatcttccagagaaaccctgggatcttcagccccagtgacatgggcttctgtcattgcagacatgtccatcttcgggcactgccctgcccatgatgacttctacttggttgtgtgtaaccactgcagccaagtggtgaagcctcaagctttccagaagcactgcgaaagaagacatgggcccctcagcaagctttatggccgggccccacccccacctccagcccctgccagctctcagaaatgccatgtagtgaatgggcagggcccagcttgtagggccccaggttccacgaaaacctcctccagggagaagggccaggggtcccggagccgtggccaccagcctcctgagaagacccagaaggacaacctctgccttttcgtgcctgtggtgaatctggagaagatgtccagtctcccgaagcctgatggacatggaatcagggtggccccaccctctgcttttctcagccagccagggggcctcaccaaggactcccctggaaaacctcccatggctcccccttctaaagaacctcctggcagagagaacatcgagatcatccccagtgaggggtccagtcactgggctgaaggcagccctcctgaaaaggagcccagtgggaccaggctgccccctaaaacccaccggaagatggctcggaaggagtgcgacctcaacaggcagtgtggggtaataaatccagagaccaaaaagatctgtacccgcctgttgacctgcaagatccactcagtacaccagcgccgggaagtccagggccgggccaaggactttgacgtgctggtggcagagctgaaggccaactcccgcaaaggggagtctcccaaggagaagagcccagggcgcaaggagcaagttctcgagcgcccctcccaggagctcccctcctcagtccaggttgtagcagcggtggctgctcccagcagcaccttctctgttcgtgccaagcagacctacccatactgtgcactgcccaggtacgtctagaatccaacccctacctcacctgggggtacttggcccctaagccatcaggggcccctggaaacaggctcagggagtgtcctggaagaggcactccctcagccctgagtgtgggggtattcctggggctcctgacagtggtgtggaagcaggagactcccctgtttccaaccaggcataccacagcaccccagcctctcggcagtgtgccagatccaacactcaggatatgaacattttcccagctgcctccaacagaccgaaacttgtcactggggagctgaaagggtcacactcctgggcaaggcagccctatgtgtattcactcactggccccttcgcgtgcagaggctatgccggaccccagggagagcctgacttgctgaaggagacacacatgcatctctgcctgtcacacaaggggcagacacgaaacacaggctcagctcacagacaggctcacaggaatatgtgatgcaagaagggggttgagcgagttgactgggctgaccagagctgggtacagttttaactgtgaagattttctggaggaggcggatctgcagcagattatcccctgaggaggaaggggctgggaggtgaaggggctggggagagaatcccttgggagcagtctctctgtctcttactctgtgagctgtgtcgttccctcctgtccttcccttccctctgtcctcttctgattgccctgcagggtgtctgccctggtgccctgctctttgagctcggcaggttcaaggatgcccctactctgaccccacaacagtcacattcccctggcatcccttttggcccttccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaaggtaccagccaggctccctgaagattgatgagggtggggcacacagggggtacctgatacagagaagatgctacattggtgtttgtgcagggaaagggaggaaggggaagttgagagagttcctggactgttttctttaggaagaggtaggtcagttcttagcaaagtgactccagctttttgcctggtgaaccttcccctatccctaaccctttcccttgggctgaggagatgcggcacccctccacccctgcttttgctataatcaaagggctacttctttctgaattggctgtgaccctcattccaggtactggagctacctctgttccctgaaggaaagggagtttgagtccctgggtcacagcctaacatgccgagcagcaagtcaaaagcccattaacgagaaagtgcctgcccactgcaacggagccgccagcacctcctcccctccagatccgggccccaggctgctgccgctttttataactttatattatttttttttaagaaaaaaagctctttaaaat

SEQ ID NO: 1966 - DNA, 726 bp, Homo sapiens
  ENST00000604728
aacattttcccagctgcctccaacagaccgaaacttgtcactggggagctgaaagggtcacactcctgggcaaggcagccctatgtgtattcactcactggccccttcgcgtgcagaggctatgccggaccccagggagagcctgacttgctgaaggagacacacatgcatctctgcctgtcacacaaggggcagacacgaaacacaggctcagctcacagacaggctcacaggaatatgtgatgcaagaagggggttgagcgagttgactgggctgaccagagctgggtacagttttaactgtgaagattttctggaggaggcggatctgcagcagattatcccctgaggaggaaggggctgggaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttg

SEQ ID NO: 1967 - DNA, 1715 bp, Homo sapiens
  ENST00000369869
cagctcacagacaggctcacaggaatatgtgatgcaagaagggggttgagcgagttgactgggctgaccagagctgggtacagttttaactgtgaagattttctggaggaggcggatctgcagcagattatcccctgaggaggaaggggctgggaggtgaaggggctggggagagaatcccttgggagcagtctctctgtctcttactctgtgagctgtgtcgttccctcctgtccttcccttccctctgtcctcttctgattgccctgcagggtgtctgccctggtgccctgctctttgagctcggcaggttcaaggatgcccctactctgaccccacaacagtcacattcccctggcatcccttttggcccttccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctcaagactgtctccctgttctgttgctgctatgaaaatataaaaacagaaacatagaaaaggaaggaaaaaaaa

SEQ ID NO: 1968 - DNA, 929 bp, Homo sapiens
  ENST00000459635
cttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaaggtactggagctacctctgttccctgaaggaaagggagtttgagtccctgggtcacagcctaacatgccgagcagcaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctcaa

SEQ ID NO: 1969 - DNA, 1457 bp, Homo sapiens
  ENST00000370626
tggacacgccccctccctgtctcccaccgatgattggcgcacggaactccgccttgggtttggaaggctcgcctgggagctcatacctggctagggccgaggattggctgttccggggctagggagcgctttctcccgggaaccgcggctgtgacccaagtggcccggaccagtttggggctgcgtgcggcctgcctcaagcaaccaggtacgtaggtcggcggcccagctcggcgctgcggtgggagccggagggcgacagtcagagccggggtgccagcgggacgcgaccgccagatccacttaggaccccgtcgttctgcgaagcggccacgtctgagtcccggggcctcctcgtgctgcagatgtcgccttaggacctcggccaggataccctctgccatgctcttgtgctgcccgtgatcaccgactggcccttgtaagcaccttcgcagagctgcgcctgccctttctgaaggctgtggaagaggttggagtgggcgcatcttagcttgccccatccccatttgaggtctgtcggagctgcccttcagtgtgagcatccacaatgggtaccccagcctcggtggtcagtgagccacccccttggcaggccccgattgaggcccggggccgcaagcaggcctcggccaacatcttccaggacgccgagctgctgcagatccaagccctgtttcaacgcagcggggaccagctggccgaggaacgggcacagatcatctgggaatgtgcaggggaccaccgtgtggctgaggccctcaagaggctgcgcaggaagaggcccccaaggcagaaacccctgggccactcgctacaccactgcagccgcctcagaatcctggagccccactctgcactggccaacccacagagtgccacagagacagcctccagtgagcagtatctgcactctaggaagaaaagtgccaggatccgccggaactggaggaagtcaggccccacaagctacctccaccagatcagacactgatccagggaaagagccaggaatggcagtgtcttccctcttgccaaaaggcctggggaggtgaaggaagagagactttaggcaagcagcccaaaggggtaaatgaaagcaagaggctgctgccactgacctgctccattcagaacaagactggatgcttctgttgagctctccattatgtgggacccattcctcaccaaaatgaggagagacagtgactgttcctgccacagtccttcccagtctaacactattcctgggctgcatgatattcccctgggagcaaagtgacaggcacttagatgcagcatttcaccactcatgctactaatcatctacctgctactactgtaaaccatggttccagcagcctgttccacacccccacaccatcaggatagcacagggaaactgtagtttaagtggcaaataaaaacatttgcatcaa

SEQ ID NO: 1970 - DNA, 4737 bp, Homo sapiens
  ENST00000301178
gggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccaacaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctactttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacga

SEQ ID NO: 1971 - DNA, 3206 bp, Homo sapiens
  ENST00000359092
gctgggcagagccggtggcaagggcctcccctgccgctgtgccaggcaggcagtgccaaatccggggagcctggagctggggggagggccggggacagcccggccctgccccctcccccgctgggagcccaacaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggc

SEQ ID NO: 1972 - DNA, 1708 bp, Homo sapiens
  ENST00000599659
aaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctacctgtaagtgaaccctatgccccactgccctggcctggatctaaaggctgtagagaatctggcctgctgggcttctgtacatgtgtgagccaaaagtttctaaaggccttgggatactagaatgtcagaaccacagaccctagaaataacagatttgtgg

SEQ ID NO: 1973 - DNA, 543 bp, Homo sapiens
  ENST00000594880
agatcccgagcctccttcccgacgggatggacgctagatcccagtcccttgggagggctcccgtcctcctctcagagcctccgccctccaccccactctgaggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccagg

SEQ ID NO: 1974 - DNA, 2557 bp, Homo sapiens
  ENST00000593513
agcacacgcgtaaacaacacgcagaactgcagtcgcacttacaagacttggtcccagggccgggcaccgagtggctctgcctgcgatccagcactttgggaggccgaggcgggaggatcgcttggggccagaagtttgagagcagcctgggcaacgtgggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggt

SEQ ID NO: 1975 - DNA, 679 bp, Homo sapiens
  ENST00000483612
agcagctggactgagactgggggacagaactccaaagcccactgagatgtgggaaaacatggagaagcacacggagcattcacaacttattgccgtcagagtcaatacatggatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataacagagaa

SEQ ID NO: 1976 - DNA, 1307 bp, Homo sapiens
  ENST00000292401
atcatttttttttctctattaggggaggagcccgtcctggcactcccattggcctgtagattcacctcccctgggcagggccccaggacccaggataatatctgtgcctcctgcccagaaccctccaagcagacacaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagca

SEQ ID NO: 1977 - DNA, 719 bp, Homo sapiens
  ENST00000419575
tgacctatatctacactgggctgtccaagcatgttgaagacgtccccgcgtttcaggcccttggctcactcaatgacctccagttctttagatacaacagtaaagacaggaagtctcagcccatgggactctggagacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagc

SEQ ID NO: 1978 - DNA, 2027 bp, Homo sapiens
  ENST00000411734
gtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaaggtactcactgcttcctgctccccagtactgagcccagaataaaagacgatctcaggctaggagctcaggcaacatcttagtccggtctcatctgttcctggatgtccctcagacccccagctttcatcttttaggatttattccttccctgggataatataatttgtggtccaaaaagaacatcatcaaaatttcaggcagaatgggccaggaaggccattctttcttgatgagtgtccccaaatcatctccaattaacagacaaggagcttgaggttagggaggtgagggtaacactgtctgtaagaggcagagctgggactcaaattccagatttcagattccaaatcccatcgttttttatctctacaatgatgcctcccatctgggtggtggagagaagggaggcgtgtaaaatgtcagccccagaaggacaagagcaagccagtgtgagcggaattgatggctgcaagctgagacttggattggagacgtagtgagactcaggattgtgcagtgctgcagggaagtggttgctggatagaggcatgggctgaaccaagcagctggactgagactgggggacagaactccaaagcccactgagatgtgggaaaacatggagaagcacacggagcattcacaacttattgccgtcagagtcaatacatgggtgaggtggggattgggcaagagggaaagcgtcagccttccctgatattctggaaagtctcccggggctgggggtgggcaggtacagagcttcgagctctgctgatcgctgacatccaggggtgggggtaggaagagacctgggccgggagaagtccacctcaagcctgcagtgtcacactctatccctccacagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctcctt

SEQ ID NO: 1979 - DNA, 787 bp, Homo sapiens
  ENST00000477251
ctggaacccctgggctcaagcgatccactcgcttcagcttctcaaagtgctgggattacaggcatgagccacagcgcccaggctgtagctctcttaaggaggaacatatctcatctgagacaaacctgaaatgccaaaccaaactgagttagcccctctctgtctgttgtatatattggagtaataacctatttgtcttgataaagggattgcatgcttgaattgcaaaaacctttatttcttttgggttgcccaatgtgcaagactaagagttattttgataaatttctcaccaggctgactgtctctctgtggggtcgggggagttttcagggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtc

SEQ ID NO: 1980 - DNA, 540 bp, Homo sapiens
  ENST00000495765
cagaaccctccaagcagacacaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacggtcagtgaataacagaccacaggggtggaaggtctaacccaagaggcagcccccccagtgtgagtggcaagggatcagcaggatggaaatagtcccaatcccaggggaagaacaggagacacagcagaaacacagacatgtccacatcccacccaccccacagcacaggtgctccccgctt

SEQ ID NO: 1981 - DNA, 4721 bp, Homo sapiens
  ENST00000337198
atcaccgagggcgggcgcctcagcccgggaggacactccccagggtaaactacaggcctcacaaagcggagggagctggacgcgaaggctcggcagcggcgccgacaggcttaccccaggcccactctaggccgcacagggttcgcgccacctccggcccaggacagctctcagacgctgccagcgtggagctcgacccggctcacaatgcgctgggccccgcagcgtgagcgcaggcgcccgagaggcggcgggggtcgggcggacggcgcgctccagccgagccgcctccctctctcggcccacacccgcgcggccgcccttcgcctgccggggagctgcgggtggctggagggcgggaagcgaccggccagtctgcacctgcatgacccggtcgcgcgccgacccctcccctctctctcccgggctcagtcctccttcctcttccgtccccctcccttttctccgggctgcaaccgggttccgccccgctcgcgcggctgcccggccagctgtgatgtcaccaggccacgccccctaatataaatactggcgtcgctggcgccgccttctcacactttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctca

SEQ ID NO: 1982 - DNA, 2857 bp, Homo sapiens
  ENST00000347770
aaatactggcgtcgctggcgccgccttctcacactttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccatggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcagtttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcat

SEQ ID NO: 1983 - DNA, 565 bp, Homo sapiens
  ENST00000518697
ttttagtagagatggagttttgccatgttgttcaggctgatcttgaactcctgacctcaagtgatcctcccacctcagcctcacaaagtgctaggattacagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttcttt

SEQ ID NO: 1984 - DNA, 839 bp, Homo sapiens
  ENST00000523071
ttgtacataaataggtggtagtcttttaaacaaagaatgggatcatgctgtgccttacacaatagataacattccatgtcagtctagttttaagttttaatttaagtcaacataaaaattaatgaagtactatctcgaatagatgaagggaaaagaagaatggactttacgggtacagttctatggattttagtacttgtgtgaccactgccacaatcaggaagtattctattctgaaactttatcactagtaatactagtgaataatagtaatgctgttactcagcttgattaatgttcatttttatttatttcacaacagacacatttttgtatttggttgggtaaaattgaatgttcagttttatgctcaactgaatgtgatacgatttggtagtgcttgttacttcactatataaacataaaagtgccacatatacataaaagcacaccttattgtataaccgtggaacagtactgataattgacttattgttaagaatttttgtttatagaattacagttttatcttggcattgccttttctataaagctggtactgtaacttttgggtaattagaagctaatgcttctaatactttaaatatttggtaaagttaatggggatacttaatggtatgaatatgatgagtgacagttgaaagaaattacaggaggtgtctctacaactttctgctcctttaaatttagtattctatgtgtttcagatttcatgtttcgagtgcttgcaaagaatctcaagtatatgtacatgctctatctgatgctcgatgtgtgtttgacatggctggagaaattggctttacgatgaacatgtt

SEQ ID NO: 1985 - DNA, 680 bp, Homo sapiens
  ENST00000521536
gtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctgga

SEQ ID NO: 1986 - DNA, 872 bp, Homo sapiens
  ENST00000522311
gataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaagattgtttttcattaggttcacttgattcatccgtcgctggatttgggagcactggcaacataatcaacacacttcctacaatcttcaggcttcacatgtgctgatgatgatgtaaaccaactctgccccaatcatctccccttctcttagggtcttactacatattgcaacagaagataatattggaggtgaagagggtaacatgaagtttggcactaccctgaagaactgtaggcatctcttggaatgtgctaaggaacttgatgtccaaataattggggttaagtgagtattt

SEQ ID NO: 1987 - DNA, 660 bp, Homo sapiens
  ENST00000520402
acacatggaggttcctggagagtggcgggcccagggagggcatggaggtttcacatccctccccctgtatcttgccctatgtgtctcttcatctgtatccttcgcaatatcctttataataaaccagtaaacacagggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggcttta

SEQ ID NO: 1988 - DNA, 773 bp, Homo sapiens
  ENST00000518353
cttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacgagttctttcctcatcatccataaatgtcattcattgagcatgtgatcagcttctcctagatagatgaaacattttgcctccaccaggagtgccttgatcctggtgagatacactttagggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacatacc

SEQ ID NO: 1989 - DNA, 574 bp, Homo sapiens
  ENST00000518940
agcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccatctctccctgttctacttccagggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcagtttgttgcatattctaaggacccagacataggcttggtgg

SEQ ID NO: 1990 - DNA, 576 bp, Homo sapiens
  ENST00000517581
actccctgtcctgctgccctgtgaagaaggtgcctgcttctcttttgccttctaccatgattagttaattgagaaagaagccatgtggtctgtggcagcagctggaggaaggcatggtgactcaacagggctctgcatggaagagtacaaggtggttctgggaagcagcaaagattggccaccccaaggctctgagggagccgcatgcaggctctaagcagaatcaggccaacccctggcctggaggaagtaggggaagagagctgccagtggcaagacctgctcaggctgtggcgaactttctgaccaagtatacaactacccagagggcctaggagaagtgctgtatagagagcagttcgacttcaacgctgagccaccttgggaacctagctgatgataggggggttccatctcccaacttgtccatggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcag

SEQ ID NO: 1991 - DNA, 1694 bp, Homo sapiens
  ENST00000430971
gccggggcgaggcgggggaggggccgtgagtgccgcagtcggccagccatggagcggagcttgctggcggcgaggccgcggcgacaaggtagccacccccgcagcatgcctcgaccgcggtccgcagctgcaccgcctctccccgccccccagggtgcgctggtcccggtcgcgcgctcagacctccgcatcccgggcgtggtcggttaagtccccggccgtgacccaggcccggggagctagtctccgcccttcgctcttacggatcccctcggagtacgccgcaccatgcagctcaggctcttccggcgcctccttctcgccgctttgctgctggtgatcgtctggaccctcttcgggccttcggggttgggggaggagctgctgagcctctcactagcctccctgctcccagcccccgcctcaccggggccgcccctggccctgccccgcctcttgatccccaaccaggaagcttgcagtggtcccggggcccctcccttcctgctcatcctggtgtgcacggctccggagaacctgaaccagagaaacgccattcgggcttcgtggggcgggctgcgcgaggcccgggggctcagggtacagacgctattcttgctgggagagccgaacgcacagcaccccgtgtggggttcccaggggagtgacctggcctcggagtcagcagcccagggggatatcttgcaggccgccttccaggactcctaccgcaacctcaccctaaagaccctcagcgggctgaactgggctgagaaacactgccccatggcccgatacgtcctcaagacggacgatgatgtgtatgtcaacgtccctgaactggtatcagagctggtcttgcgagggggccgttgggggcaatgggagagaagcacggaaccccagagagaggctgagcaggaaggaggccaggttttgcacagcgaggaagtgcctcttctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgctgacgtcccacaggctggacccctggaagatgcaggaagcctggaagctggtgggtggctctgacggggaaaggactgcgcccttttgctcctggttccagggagtcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccaggggcctggcccgccagcccaaaagatggtcatcgggaagagaaaaagaaaaaaatgctgcagttgttctctcaagctagggcagaagaggggtgtcaagctcctcaataaacttgtctccacttc

SEQ ID NO: 1992 - DNA, 1694 bp, Homo sapiens; identical to SEQ ID NO: 1991
  ENST00000419471

SEQ ID NO: 1993 - DNA, 1694 bp, Homo sapiens
  ENST00000383209
gccggggcgaggcgggggaggggccgtgagtgccgcagtcggccagccatggagcggagcttgctggcggcgaggccgcggcgacaaggtagccacccccgcagcatgcctcgaccgcggtccgcagctgcaccgcctctccccgccccccagggtgcgctggtcccggtcgcgcgctcagacctccgcatcccgggcgtggtcggttaagtccccggccgtgacccaggcccggggagctagtctccgcccttcgctcttacggatcccctcggagtacgccgcaccatgcagctcaggctcttccggcgcctccttctcgccgctttgctgctggtgatcgtctggaccctcttcgggccttcggggttgggggaggagctgctgagcctctcactagcctccctgctcccagcccccgcctcaccggggccgcccctggccctgccccgcctcttgatccccaaccaggaagcttgcagtggtcccggggcccctcccttcctgctcatcctggtgtgcacggctccggagaacctgaaccagagaaacgccattcgggcttcgtggggcgggctgcgcgaggcccgggggctcagggtacagacgctattcttgctgggagagccgaacgcacagcaccccgtgtggggttcccaggggagtgacctggcctcggagtcagcagcccagggggatatcttgcaggccgccttccaggactcctaccgcaacctcaccctaaagaccctcagcgggctgaactgggctgagaaacactgccccatggcccgatacgtcctcaagacggacgatgatgtgtatgtcaacgtccctgaactggtatcagagctggtcttgcgagggggccgttgggggcaatgggagagaagcacggaaccccagagagaggctgagcaggaaggaggccaggttttgcacagcgaggaagtgcctcttctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgctgacgtcccacaggctggacccctggaagatgcaggaagcctggaagctggtgggtggctctgacggggaaaggactgcgcccttttgctcctggttccagggagtcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccaggggcctggcccgccagcccaaaagatggtcatcgggaagaaaaaaagaaaaaaatgctgcagttgttctctcaagctagggcagaagaggggtgtcaagctcctcaataaacttgtctccacttc

SEQ ID NO: 1994 - DNA, 1694 bp, Homo sapiens; identical to SEQ ID NO: 1991
  ENST00000415322

SEQ ID NO: 1995 - DNA, 1694 bp, Homo sapiens; identical to SEQ ID NO: 1991
  ENST00000451237

SEQ ID NO: 1996 - DNA, 800 bp, Homo sapiens
  ENST00000606990
gggagacacccaggggcctggcccgccagcccaaaagatggtcatcgggaagagaaaaagaaaaaaatgctgcagttgttctctcaagctagggcagaagaggggtgtcaagctcctcaataaacttgtctccacttcttcgagtgcagtgtggtcttcaccaggacccccagaacaccacaaacctggagagcccagaggctgccagaccctgctgcatgggaaggacatctccagggacatgggagagaggacagcctctctgaggaggaaggcccctaaaaggcaaagctaaggccacagcagccacaagaacctcagcgcagagccctgcccacagcaggtgcccagtgaatacctgatgacaaaaggaatcagaggaaaatacaaatcagacagaaaagctgtggaaaatgcagatactccctcaggaacagcagaaatccaaagcagacaccacctccacccctcacatcagccagacctggagagaacgatcatcttgaatgacaatgatgaacacagcgctccctattttgctaagcgctgtgctaaactatatgccttaactcatcttaatgtctacaacagcttatatgagggctttaaaccaaggcttggtaaactactgcccatgggccaaacctggcccatcatctagttctgtatagcccacaagccaagaatggtttttacatttttaagtggttgaaaaaaaatcaaaagaatattttgagactgtgaaaaccgtatgaaattcaaattccaatatccaacaaataaagttttattggaacggg

SEQ ID NO: 1997 - DNA, 6565 bp, Homo sapiens
  ENST00000230053
tgagaagacaagagcaagggactgagagcaggcttccgctgcggcgcgcgaacacagccgggacacaacccccagcgtctccacccgctcctcgccaccccggcgggaatgtgaggaaggaaagcccccagcgccgccgcccgccctcgaaggcgtcccagagagcgtcctgggggcccgcggctggagcccttgtgcccgcagcaccgccggactggagcggcgaggcgcaccgggtgccgcttctcggcttccactcttcagaaagagcgcggtggggatcagcgcctttcccgcactcggcacaactccgggaccggcggcgcgcggctggaccgagtcccgcttcccgccagctcacctggagtcgggggcagcccctgcccgcccgcctgcaccccttgtcgctctagcttgcgcgaacctgccgctcctccacgcccaggtagtgagccccgcggctccaggtctctgcagcgccctcggccccatggacagcgcacccatcaccactccctaagtgctggcgccgccgctgtccaagctgcgcactggggtccctcggctcgcccctctctggggtgtccgagaggccagggagcgtgcaccatgaagtccgcgcttttcacccgcttctttatcctcctgccctggatcctaattgtcatcatcatgctcgacgtggacacgcgcaggccagtgcccccgctcaccccgcgcccctacttctctccctacgcggtgggccgcgggggcgcccgactcccgctccgcaggggcggcccggctcacgggacccaaaagcgcaaccagtctcggccgcagccacagccggagccgcagctgcccaccatctatgccatcacgcccacctacagccgcccggtgcagaaagcggagctgacccgcctggccaacacgttccgccaggtggcgcagctgcactggatcctggtggaggacgcggcggcgcgcagcgagctggtgagccgcttcctggcgcgggccgggctgcccagcactcacctgcacgtgcccacgccgcggcgctacaagcggcccgggctgccgcgcgccactgagcagcgcaacgcgggcctcgcctggctgcgccagaggcaccagcaccagcgcgcgcagcccggcgtgctcttcttcgctgacgacgacaacacctatagtctggagctcttccaggagatgcgaaccacccgcaaggtctccgtctggcctgtgggcctggttggtgggcggcgctacgaacgtccgctggtggaaaacggcaaagttgttggctggtacaccggctggagagcagacaggccttttgccatcgacatggcaggatttgctgtaagtcttcaagtcattttgtccaatccaaaagctgtatttaagcgtcgtggatcccagccagggatgcaagaatctgactttctcaaacagataacaacagtcgaagaactggaaccgaaagcaaataactgcactaaggttctcgtgtggcacactcggacagagaaggttaatctagccaacgagccaaagtaccacctggacacagtgaaaattgaggtataaattgaagcagcaactggtgcagtttgtccagccagtggatccatatggaagaggatgtttggagtttaggctacagagcattcaggtattgtttgttttacttcagtacagcagcctttcttgtcatctgatggacatctgtttaaatggagcttgtcagttaacataagctaattggatggttggtacaaaatgtatgttttgtcttcatttgttctgcatgttttctctacaacaactaaattggaagatttttttgtacagtgccgatactgcaagataccactcttgagtatatattttttctttttctccaatttgcccttataattggtagacttgaacaggttggtagacttgaacaggtttttaaaacagacaagtattttgtcagctaaacgttcctgatgattcctgactttgcaatactaagtaatttttggaaggttagtggcagtatacatcataggaaataaaaacccacaaatgaaaaggtctatggagtcatgtttaatgtagggaaataacattttgtcaatactaggcaccataaaatgtaaacacaattactgtcataaacctagatataccttcaaggattgaagattgaaagtggctttgttttagttagttaccctgtttgcatatagtgcagaaaaaggtcttcatgttagcactatgtacattaagaagagatccaaattacaagagaggcagataaaatttgaattctttaagcattcattaaacgaagttttggagtaacatccacgtttatcttcctttcactaatcacgttccctgttaagcacatcataacaacagcacagtgaagtgaatgatgaaataagagcattttgatacactagaaaacagtgctcagtgagacatttacattctatttatatgattaaacatttgatcatacagtaccttcctacaggattactggctaattttggggtggggtttatactattagaggtattactaacatgataactacttcccttatatgcaaacattagagctataattttattgagaggaaaactgattttgcaagttgagcagcttctcaaataatgcagtacatgaaatcatgggaaatatgagcaaagctgcccttgacataaaatgatttatcaacctgcttttcaccacatcaaattgaatcagtacagaccaacacggtcaatcagatcattcttaatatgaacaaatgggtaaaaagaaaaaaaatatgcatatgaataaacaggggaactagatgcgtttcagcaaggaatgtcaggtggtagttctggatgaaacttgtattgcagttttcatttccacagttgtgtgctgagagtctgacctgatgagcttccagaccatcctgctgttgtgctggagggctggccaaaacctgcagtaggggttgcactactgatactcatgccagccatctgctgattcatctgtgaaacatataaaaggcttagttcaagaggcttacttcacttttaattcttgtttctttagccacacagttggtcattttttcattaatgtgacaactagtccaagcactggaataaaaacagagtaccatacaaatatttcttaaagcaaatagctactttgttcccttctttatctactttctagatacagtttccccaaagattaaccacaacttacttaaaaaaaaataccaaagcaatcttgggattttaatgagtccgctactctaactaactttcacctacactaggatattgtgctttaactactaaggagtaagaaaattttaggaagtaaaatagtctaaaattatcctataaactttgtatgatagatattattctctattaaaatcttatatacttcctaaatatttttaaagtggtcataaagcatttatttctctcgctgatctaacaacataaacatctaaaatttattttcattgtatgcaataaagcataagattacatgtatttttcttcaagactggagtcaaatatatatatatataagcatcttaaccctgtgattctcttacttccaaaattggtgataagagaaggaaaggcaagatttaccatatagtgagtgggtttaaaacttacactcagagttagactgtgttcttaatttaatacatttgacttgacttatttacagtttcaaagacactaacataaactacatcactaatcaggcataagtgtctgaagaagcagatcacgtcttcatacctactaaaggacattttaaccaccttgtcattggccagtagattgcactgatggagtgctggagaacagcatcacccttctgcattatctggaagtaagagccagtattaactccttcctggttcatctagcaccttaacctgagctgggtgtgcttcagcatgttgaccatgtgactgacacttagcacatacaattttttagattcccagcgggtagagaccaatgttttacctatattcttgtaaatggtggtagcaaaattaactgtgatatatagtgattgtgctaatgttagaaatcactctagactattccctgaatgctctaaaggtaaaacaagtgaccaaacagaaaccaagattgccaaaatgctggaggaacatcaatgggaagtgtaaaaggaagaagagtgggagcatgaacctctctaagagcctttgtctgtgcagctagagaaaagtcagaacacagcacctgaaatagaaatgttctatctcagctctaacttaggtagaaataggattttataatatgaggggatgtctggttcacaccttatgggaattgaatctttttgtactctttttaaacataaaagtcattatagggtatgtaaaaagaaaatacaactttacaaaggtttctcaacaaaaagaatttttacagagccatggggcagtaatcatccgacctgaaaaatagccttagatccctcataaaatagtgctttgagaatatgaggctagatttttattttctaataaaagatcctaaaattattagtgaagctaagttgtctaagtggactgtaaaaatgtcccaccagcaagctggataaagcttagtgctaatctcagaggtgacagagagggagtctcatgatgcctgagataatttctggccattagtggtgttcacgttacagttacattacaatttgaaatgaaagatgtttaaccttttttttacagaatactctaaaatagcgataataacacatcatttgtctatctgatacaacttcataatatttatagatacttttgaccctataacatattatccctattgaattctttctgccagatcactagacttaaaaaaaaaaaaaaaaaaaaaaaaaaaagatttagaaaataaatctggtttgatttgggagaagctagaaagtaaatgacccctacctgtgagaggctccactggggctgctgagcttgcggcaggccaaacttactctggggtgcacccatttgtcccaccattcctccttgggggccaacaacgttctgaggaagtggcatcacaccagtttgtgcatttcccataaacccattgggcatgggcatgcccaccatcatgcttggactctgtcccatcacatttcctataaggccaggagctgcaggcacaggcacgcccatcgatggaaagccctgaaatgcagctggtgcttgtgaggtaaatggtatatttgtgggtcccataaatacacctgcaccacaaaaagaaaatgaatgaagacagagctatcacgtgtagttgcactcatctctataatcacagaaaaattgcctttctgaactactcacagcaaacattttaattccagtttggctgctcctactactcagaccaacccacacctaaaccctgagagctggttgtttctaggatgcagacaaatcagttattaacctgagtaaatttaattaagaaatgtaaatcatatgcaacagccacacaaaatatcttccactgtgaagaccaaactatgtagcatgacatcatacactgttttattgctgatttgtaccactggtcccccagtacgaaacagggaagtgagagctgactatatctcgcttcaataggtgtagtgggctgcccaacaattttagctcacatgtgaaatgcagctcattattttaaaggaaatggtgtgaaagattaaaactctgtaaacaataaggcttatgctaatattttgttatgattacaaaaaaattcatagattttttttaatccatgtggtaactcaagactgtttacctgcagagaaaatacactgtacgcagtcataaacttcatgcaaatcgtttcaataattcatcaaagataatccatgttctataagcttgtgaaacaacatttagtgatctatgaacagcttgttaattccaaataaagttctgtgaatcctgtacatgcctcttaattttttaattctaatgctcattcatttcggcttcatagttgtataaactgcaacaacaaaagcactcactacatggaacaataaaagatatataattgatcttattatataattacaaaggatgtacttctagtaatgtcactgaaagcagatatcaaaattcattaccaggagtactttgctgttgaatggttcctgtgccatacagagataagatggagtctttggaaagttgtttctttgccacttcttctgattttgtagtttgctcagtgaataaatctagatccccagatgttactgtagacagggttgcagctgctggtgcagagggtgtcccctgagacaaacaccaaaataagctatcaaattctgcatagtaaagcgcagcttatccattacttaaaatccaaataaagttataaaattagataggaatcaaacaattgtagaaggtaaaatggtgccattcaagaggatcacttacaagcccaagcccatataaaaacatctacaatca

SEQ ID NO: 1998 - DNA, 5206 bp, Homo sapiens
  ENST00000615536
atgaagtccgcgcttttcacccgcttctttatcctcctgccctggatcctaattgtcatcatcatgctcgacgtggacacgcgcaggccagtgcccccgctcaccccgcgcccctacttctctccctacgcggtgggccgcgggggcgcccgactcccgctccgcaggggcggcccggctcacgggacccaaaagcgcaaccagtctcggccgcagccacagccggagccgcagctgcccaccatctatgccatcacgcccacctacagccgcccggtgcagaaagcggagctgacccgcctggccaacacgttccgccaggtggcgcagctgcactggatcctggtggaggacgcggcggcgcgcagcgagctgatgcgaaccacccgcaaggtctccgtctggcctgtgggcctggttggtgggcggcgctacgaacgtccgctggtggaaaacggcaaagttgttggctggtacaccggctggagagcagacaggccttttgccatcgacatggcaggatttgctgtaagtcttcaagtcattttgtccaatccaaaagctgtatttaagcgtcgtggatcccagccagggatgcaagaatctgactttctcaaacagataacaacagtcgaagaactggaaccgaaagcaaataactgcactaaggttctcgtgtggcacactcggacagagaaggttaatctagccaacgagccaaagtaccacctggacacagtgaaaattgaggtataaattgaagcagcaactggtgcagtttgtccagccagtggatccatatggaagaggatgtttggagtttaggctacagagcattcaggtattgtttgttttacttcagtacagcagcctttcttgtcatctgatggacatctgtttaaatggagcttgtcagttaacataagctaattggatggttggtacaaaatgtatgttttgtcttcatttgttctgcatgttttctctacaacaactaaattggaagatttttttgtacagtgccgatactgcaagataccactcttgagtatatattttttctttttctccaatttgcccttataattggtagacttgaacaggttggtagacttgaacaggtttttaaaacagacaagtattttgtcagctaaacgttcctgatgattcctgactttgcaatactaagtaatttttggaaggttagtggcagtatacatcataggaaataaaaacccacaaatgaaaaggtctatggagtcatgtttaatgtagggaaataacattttgtcaatactaggcaccataaaatgtaaacacaattactgtcataaacctagatataccttcaaggattgaagattgaaagtggctttgttttagttagttaccctgtttgcatatagtgcagaaaaaggtcttcatgttagcactatgtacattaagaagagatccaaattacaagagaggcagataaaatttgaattctttaagcattcattaaacgaagttttggagtaacatccacgtttatcttcctttcactaatcacgttccctgttaagcacatcataacaacagcacagtgaagtgaatgatgaaataagagcattttgatacactagaaaacagtgctcagtgagacatttacattctatttatatgattaaacatttgatcatacagtaccttcctacaggattactggctaattttggggtggggtttatactattagaggtattactaacatgataactacttcccttatatgcaaacattagagctataattttattgagaggaaaactgattttgcaagttgagcagcttctcaaataatgcagtacatgaaatcatgggaaatatgagcaaagctgcccttgacataaaatgatttatcaacctgcttttcaccacatcaaattgaatcagtacagaccaacacggtcaatcagatcattcttaatatgaacaaatgggtaaaaagaaaaaaaatatgcatatgaataaacaggggaactagatgcgtttcagcaaggaatgtcaggtggtagttctggatgaaacttgtattgcagttttcatttccacagttgtgtgctgagagtctgacctgatgagcttccagaccatcctgctgttgtgctggagggctggccaaaacctgcagtaggggttgcactactgatactcatgccagccatctgctgattcatctgtgaaacatataaaaggcttagttcaagaggcttacttcacttttaattcttgtttctttagccacacagttggtcattttttcattaatgtgacaactagtccaagcactggaataaaaacagagtaccatacaaatatttcttaaagcaaatagctactttgttcccttctttatctactttctagatacagtttccccaaagattaaccacaacttacttaaaaaaaaataccaaagcaatcttgggattttaatgagtccgctactctaactaactttcacctacactaggatattgtgctttaactactaaggagtaagaaaattttaggaagtaaaatagtctaaaattatcctataaactttgtatgatagatattattctctattaaaatcttatatacttcctaaatatttttaaagtggtcataaagcatttatttctctcgctgatctaacaacataaacatctaaaatttattttcattgtatgcaataaagcataagattacatgtatttttcttcaagactggagtcaaatatatatatatataagcatcttaaccctgtgattctcttacttccaaaattggtgataagagaaggaaaggcaagatttaccatatagtgagtgggtttaaaacttacactcagagttagactgtgttcttaatttaatacatttgacttgacttatttacagtttcaaagacactaacataaactacatcactaatcaggcataagtgtctgaagaagcagatcacgtcttcatacctactaaaggacattttaaccaccttgtcattggccagtagattgcactgatggagtgctggagaacagcatcacccttctgcattatctggaagtaagagccagtattaactccttcctggttcatctagcaccttaacctgagctgggtgtgcttcagcatgttgaccatgtgactgacacttagcacatacaattttttagattcccagcgggtagagaccaatgttttacctatattcttgtaaatggtggtagcaaaattaactgtgatatatagtgattgtgctaatgttagaaatcactctagactattccctgaatgctctaaaggtaaaacaagtgaccaaacagaaaccaagattgccaaaatgctggaggaacatcaatgggaagtgtaaaaggaagaagagtgggagcatgaacctctctaagagcctttgtctgtgcagctagagaaaagtcagaacacagcacctgaaatagaaatgttctatctcagctctaacttaggtagaaataggattttataatatgaggggatgtctggttcacaccttatgggaattgaatctttttgtactctttttaaacataaaagtcattatagggtatgtaaaaagaaaatacaactttacaaaggtttctcaacaaaaagaatttttacagagccatggggcagtaatcatccgacctgaaaaatagccttagatccctcataaaatagtgctttgagaatatgaggctagatttttattttctaataaaagatcctaaaattattagtgaagctaagttgtctaagtggactgtaaaaatgtcccaccagcaagctggataaagcttagtgctaatctcagaggtgacagagagggagtctcatgatgcctgagataatttctggccattagtggtgttcacgttacagttacattacaatttgaaatgaaagatgtttaaccttttttttacagaatactctaaaatagcgataataacacatcatttgtctatctgatacaacttcataatatttatagatacttttgaccctataacatattatccctattgaattctttctgccagatcactagacttaaaaaaaaaaaaaaaaaaaaaaaaaaaagatttagaaaataaatctggtttgatttgggagaagctagaaagtaaatgacccctacctgtgagaggctccactggggctgctgagcttgcggcaggccaaacttactctggggtgcacccatttgtcccaccattcctccttgggggccaacaacgttctgaggaagtggcatcacaccagtttgtgcatttcccataaacccattgggcatgggcatgcccaccatcatgcttggactctgtcccatcacatttcctataaggccaggagctgcaggcacaggcacgcccatcgatggaaagccctgaaatgcagctggtgcttgtgaggtaaatggtatatttgtgggtcccataaatacacctgcaccacaaaaagaaaatgaatgaagacagagctatcacgtgtagttgcactcatctctataatcacagaaaaattgcctttctgaactactcacagcaaacattttaattccagtttggctgctcctactactcagaccaacccacacctaaaccctgagagctggttgtttctaggatgcagacaaatcagttattaacctgagtaaatttaattaagaaatgtaaatcatatgcaacagccacacaaaatatcttccactgtgaagaccaaactatgtagcatgacatcatacactgttttattgctgatttgtaccactggtcccccagtacgaaacagggaagtgagagctgactatatctcgcttcaataggtgtagtgggctgcccaacaattttagctcacatgtgaaatgcagctcattattttaaaggaaatggtgtgaaagattaaaactctgtaaacaataaggcttatgctaatattttgttatgattacaaaaaaattcatagattttttttaatccatgtggtaactcaagactgtttacctgcagagaaaatacactgtacgcagtcataaacttcatgcaaatcgtttcaataattcatcaaagataatccatgttctataagcttgtgaaacaacatttagtgatctatgaacagcttgttaattccaaataaagttctgtgaatcctg

SEQ ID NO: 1999 - DNA, 4254 bp, Homo sapiens
  ENST00000343307
cgatggcgcggcggagacggagggaggaggggagccggcagagaagggtcagccgcggcggcagggcggcggcggcagcggcgcagctccgctccccgcgcgtctcccttccccgcgcccaggtagggcgctcagcctccgccgccaggatgcggccgcccgcctgctggtggctgctcgcgccgccggcgctgctcgcgctcctcacctgctccctggcttttggtttggcttctgaagatacaaagaaagaggtcaagcagtctcaggatttggagaaaagtggtatatcaaggaaaaatgacatagacttaaaaggaattgtattcgtcatccagagtcaaagtaattcttttcatgcaaagagagcagagcagttaaaaaaaagcatcttaaagcaggctgcagatcttacacaggagctccccagtgtcctcctccttcatcagctggctaaacaagaaggtgcatggaccatacttccgttgttaccgcatttttctgtaacatatagcagaaattcatcttggattttcttctgtgaagaagagacaagaatacagattccaaaactcttggaaaccctcagaagatatgacccctctaaggaatggtttttgggaaaagcattacatgatgaagaagctacaataattcaccattatgccttttccgagaatcctacagtttttaagtatccagactttgctgcaggctgggccttaagtattccacttgtaaacaagcttaccaagagactaaagagtgaatccttgaaatccgactttacaatagatttaaaacatgagattgccctctacatctgggacaaaggcggaggacctcccctgaccccagtgcctgagttttgtaccaatgacgtggacttctactgtgctaccacattccattcttttctaccgctttgtagaaagccagtgaagaagaaggatatttttgttgcagtaaaaacatgcaagaaatttcatggtgacagaatacctattgttaagcagacttgggagagccaggcaagtctcattgaatactatagtgactatactgaaaattccattcctactgtggatttgggaattcctaatacagatagaggtcattgtggaaagacatttgccattttggaaagatttctgaatcgtagccaggacaaaacagcatggttagtcattgtggatgatgatacattaataagtatctccaggctccagcacttgcttagctgttatgactccggcgagcctgtgtttctgggagagcgctacggctacggcctgggcactggtggctacagctacatcacgggaggaggaggaatggtcttcagcagagaagccgtcaggagacttctcgccagtaaatgtcgatgctacagcaatgatgctcccgatgatatggtcctgggaatgtgctttagtggcttgggaatccctgtgacacacagccctctcttccatcaggctcggccggtggattaccctaaggactacctttctcatcaagttcccatatcgttccacaaacactggaacatcgatccagtgaaggtgtatttcacatggttggcacccagtgacgaagacaaagccaggcaggagacacagaaaggttttcgagaggagttataaatcagggtgacctgtgcgcctagcctgcgcagggaatgaactggagactgtggcctcatcccactgtgctgtgctcacaacacttgtgtctgccacatggcattgggtgcttcctgactttagggggagattttatgtatggtattttttgacagaggaagaaaaggggtcacaggagaaacatttttttttctgggaaaaatcacttgcttttgacttatgcagttgttttaacacttagtgatgactgtgtattctccaagctgtgatacagcagtttttttttattgtcacagggaaataaatggtaccagaagtccctttcctgttctgtctcttcattgtaatggaagtttcagttgggcatgagcctggagagatgtgactgtctacagttctatttgtatatataaaaagaagactgaaagtcttttgacatggatattgtgaatggtatgaacttttaaaccatattattgatgatgaaaattatttcctgggaactcagtaggaataataccgtattaaggaataatactgtacataaaacatcatgaaaccctagatatgaaatcccctgaagtctgtaatcatggtggttatgttttgtctattcttttgctgtttgtgcctcataaaaagagaatgaggtcttctgctagagcttcgtattgctttggaagttcatctgtgttttatttctccctgaagccctatctttatggcttacttgtaacatgaaagtagtagatgctgccagaaaatagtgtcctcaatattttaaaacaatgttgacatgttttgttcaagtcagcaagctctatgtgagtctcaggaagtgaattaaatttggaccttatgttttactcttgttttttttttttttttaaatgttacttaatgactctctcctgactcaggagagaaaccccttgtggaaggacagcatggtgatcaggcaatttctctgggttcccaaagaatgacatttgaacacagtattttgaaacagctctagttttcaaattatatctttaatatatagtaatgtaacatattcagtattaatgtataaaaagcactctaattatataattcagtttttgtaaaggtatttgcataaaatttaatatgtcttaaactaattttggtaaattacttcttttttttctttttaataaaaactgttactcattaactttgcttataatgctttttatagcccagcacagaatttaaagccataccaccaaaagtacctgtgtgtgttaatatgtttttcttgtagcatagattgactatttgcaatagtattagtatttaccatttttccaaattagcaactaccagacctcacgtgttgcagtgataacacaatgcattggattcagttttgtgaaaatggattctgtggccatccaagggatgtatcagggatgatcagctgatgagaggctccagaaggatttctagatcgcttcaagcctatactgatggccttagctttgttcagtcattgtaactgggattgttgtcattgctaccgtggtagtcaccttcatgtcatctataatagtactcctggagagccctggctgcctacaccagtggaaaagagtctccagttctgctctggcctactaactgttaccactgagagaacaacatgttcatttgacatgattgaagctggcatccgtatatgaagatccttgtcaagctttcttctgtggtctgattagtgccttctactgataccggggcacctcctctggtacttttaagtgttttgttaattatatttactttttggaatggtgtaagcctaaccacaagtaaaagatctttgcctaagtttttgatttctcaaatattgtgttcattagtctagactgggaatggggaggggaaatggggaaaatgaatgaatgaaatcagaaaaaagtcagcggctcagtaaatacagtttaaagagagaataattacttcagagctacccttttaagagaaaaccatcagaaattgataatgtttatataaagtttataaagccattgtgttttgttatataacaaatcagagatgttattttagaatcgattcccatctaaagaactcaattttgagtctgacatttccaggaccagatattgtcttactcacatttcctttgctttgaaatagggctttccttccaaatggctatttttaggctagggatgttaacatcagggatttgtgtgtggaataactggaatgtcatttttgcttttaagccatttctgatgatatagccaaagcaggttgtctgactatgtaggatttttacatcttgaaactaaatcagaaatccagacatgaaaataacctttctagaatgcctaggagcagaaaacaataatagcatgctaaatcacaaatgatgctatgtatgggtatgtaaatatcagtgctgtctgcatttctgggtttattgaagacctcttgttgtatatatcctcaaaaattaatgtaattgacatcttcaagaatgtttctattgtcttccattcataatcagagatgtaatttgtatggactaaataaaaactttattatgtaatgaaaa

SEQ ID NO: 2000 - DNA, 811 bp, Homo sapiens
  ENST00000461652
tcatcctagcacatttcagtcactacctgaagttatttgatttactttcttaatttccatttctccactctagggaatggtttttgggaaaagcattacatgatgaagaagctacaataattcaccattatgccttttccgagaatcctacagtttttaagtatccagactttgctgcaggctgggccttaagtattccacttgtaaacaagcttaccaagagactaaagagtgaatccttgaaatccgactttacaatagatttaaaacatgagattgccctctacatctgggacaaaggcggaggacctcccctgaccccagtgcctgagttttgtaccaatgacgtggacttctactgtgctaccacattccattcttttctaccgctttgtagaaagccagtgaagaagaaggatatttttgttgcagtaaaaacatgcaagaaatttcatggtgacagaattaattgagaagaaacacccgtgttctttaataaacctattagagcgaaaaaggactgaaagcctaaaggctgaggaaattgaaagcaaaatttgcacagcctgcaggacccttgctggggactgaggaaagttcttgacctttcctcacagcttcttccagcattatgcaatggaggatattttacccaacagtgtgaacttttagtggctgcaagctgcagggagccctttctgggtacctattgttaagcagacttgggagagccaggcaagtctcattgaatactatagtgactatactgaaaattccattcctactgtggatttgggaattcctaatacag

SEQ ID NO: 2001 - DNA, 4123 bp, Homo sapiens
  ENST00000326505
atcccgcccgcatacagcccgcatcccgccggggaagcgagcccagtccagcgctgcccgtccagtcctcgcccaagatttaaagcccgcaagttttgttcttgagaccagcgactttagctccgatgcgggaaggaaagccgacctccgatttggacatttaaagagctgggcttgaacttcgtgagtttcgctctaaactgcccttgaaatgaagctggacttggaggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaattatcatga

SEQ ID NO: 2002 - DNA, 561 bp, Homo sapiens
  ENST00000493370
agcccagtccagcgctgcccgtccagtcctcgcccaagatttaaagcccgcaagttttgttcttgagaccagcgactttagctccgatgcgggaaggaaagccgacctccgatttggacatttaaagagctgggcttgaacttcgtgagtttcgctctaaactgcccttgaaatgaagctggacttggaggtaaagtcactgggaagctggcctggggcggggtttccccctcttctcgtattttagaaacggacagcggcagtgcagccctagtttgctgtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaact

SEQ ID NO: 2003 - DNA, 550 bp, Homo sapiens
  ENST00000480551
agcgactttagctccgatgcgggaaggaaagccgacctccgatttggacatttaaagagctgggcttgaacttcgtgagtttcgctctaaactgcccttgaaatgaagctggacttggaggtggctgatcaggacagtatgaaatttcatacagtttcctaacttgagaaaacatggtgatgcaattcctccaaccaggagggatttatggacagcggtggctacgtcctaatctgcccagaatacaggatgactaaacaaattggcaaacggacgcagctttctctctctctaagaaaagtctgctgagaaccctcgttcccactctgtttctgcctccaagaagaaaagcctaaaactcactttcttccggactctttcaaggaagctgattaaaagaagctcctaaaccagaggtgcagacaaggtgatgatgtggctctcagaggaaggtgtgctacctacaaccctgctggcttcatggaagaatatgcttctcaaatgcaaatccaatcaagttatctccctgcttaaatccaaactcgctcat

SEQ ID NO: 2004 - DNA, 608 bp, Homo sapiens
  ENST00000464191
agtttgctgtaagtttccttactttgttactgaggcccccagagctccacgcataagtggtgtgaccagaaaccttttaacaagacccgcctgagcctgcgttagagctcccgctcggaaagtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctg

SEQ ID NO: 2005 - DNA, 3368 bp, Homo sapiens
  ENST00000460419
ctgggccggtggttccgcgcggagttagtctgtggtcagttacgtggtgaaaacacggctgtgccgcggccgcatctttccgcggccgaggcctctctgggtgggagtgttggcttcctttccggatcgctaaatggggaaagttctggccgctcggcgggatacgtctccaggccacggatggttcgttctccgtgccgcggccccgagctgggctccctgggtctccagcgcgggctcccggcattgggggctgcgggccggcccctccgccccgcccccgccccgccgcgcctcctcggccgagcggctcgcggtctccggcgcgggaggctccgagtctgcccactccgggccgagcgaggtctctggaggagaagagtggcgaggaggtgagggcacgccggccctcgcccggcgggtggcgccaggacttcaggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgc

SEQ ID NO: 2006 - DNA, 684 bp, Homo sapiens
  ENST00000464923
gaacgccgcgcccaccaattcggttgccggccgggggccccaggcttgcggccacccgcctccggctggagggctgaattcgagtcgaaagcccgtgtcgggctggaaagaagaaaccgccaacctgagaacgctttcggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaa

SEQ ID NO: 2007 - DNA, 715 bp, Homo sapiens
  ENST00000496270
gagtttctagtctgttgattggccactgacccgtgctgcaggcacacaaaggaagctgcacccacagcagtctgttgtggatggttgctgagctgcgcattcggcattgggcttgctttgtttcctgccaggcccagcattttcttctaccagatcggcaggcttgtgggcttcttcctaggtccctcccctgcactctgaataggaaagctggaagctgtgctttagagaagctttaagacgccgaaagaaaccagaagagtgagcgccagttgtatgtgcgtggtctccatccgcaaagccggagctgggcgcaacagtgttgacttaaagcattttgacttgttgatgtcaatttggaacagctgaaaaaatacaggaaaataagataaatacgtacatgttgagggtggggacaaaatgaaggttctgaaccagctgccggcttacagtagccatataagcaacagcagcaatgcaccaacctggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaac

SEQ ID NO: 2008 - DNA, 1766 bp, Homo sapiens
  ENST00000465010
tgcacccacagcagtctgttgtggatggttgctgagctgcgcattcggcattgggcttgctttgtttcctgccaggcccagcattttcttctaccagatcggcaggcttgtgggcttcttcctaggtccctcccctgcactctgaataggaaagctggaagctgtgctttagagaagctttaagacgccgaaagaaaccagaagagtgagcgccagttgtatgtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaa

SEQ ID NO: 2009 - DNA, 663 bp, Homo sapiens
  ENST00000488301
agcagtctgttgtggatggttgctgagctgcgcattcggcattgggcttgctttgtttcctgccaggcccagcattttcttctaccagatcggcaggcttgtgggcttcttcctaggtccctcccctgcactctgaataggaaagctggaagctgtgctttagagaagctttaagacgccgaaagaaaccagaagagtgagcgccagttgtataaagcattttgacttgttgatgtcaatttggaacagctgaaaaaatacaggaaaataagataaatacgtacatgttgagggtggggacaaaatgaaggttctgaaccagctgccggcttacagtagccatataagcaacagcagcaatgcaccaacctggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagac

SEQ ID NO: 2010 - DNA, 528 bp, Homo sapiens
  ENST00000477699
tgtggatggttgctgagctgcgcattcggcattgggcttgctttgtttcctgccaggcccagcattttcttctaccagatcggcaggcttgtgggcttcttcctaggtccctcccctgcactctgaataggaaagctggaagctgtgctttagagaagctttaagacgccgaaagaaaccagaagaaaagcattttgacttgttgatgtcaatttggaacagctgaaaaaatacaggaaaataagataaatacgtacatgttgagggtggggacaaaatgaaggttctgaaccagctgccggcttacagtagccatataagcaacagcagcaatgcaccaacctggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccattt

SEQ ID NO: 2011 - DNA, 614 bp, Homo sapiens
  ENST00000481531
attcggcattgggcttgctttgtttcctgccaggcccagcattttcttctaccagatcggcaggcttgtgggcttcttcctaggtccctcccctgcactctgaataggaaagctggaagctgtgctttagagaagctttaagacgccgaaagaaaccagaagagtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatac

SEQ ID NO: 2012 - DNA, 2748 bp, Homo sapiens
  ENST00000462559
ggctgatgttcacttttgaagaggaccacaatgaaacccttttaatattactcaatgattccacagacctcctgggtgttaaatcaggtgaatctatttttaaaaattgctatttacttttttaggtggctgatcaggacagtatgaaatttcatacagtttcctaacttgagaaaacatggtgatgcaattcctccaaccaggagggatttatggacagcggtggctacgtcctaatctgcccagaatacaggatgactaaacaaattggcaaacggacgcagctttctctctctctaagaaaagtctgctgagaaccctcgttcccactctgtttctgcctccaagaagaaaagcctaaaactcactttcttccggactctttcaaggaagctgattaaaagaagctcctaaaccagaggtgcagacaaggtgatgatgtggctctcagaggaaggtgtgctacctacaaccctgctggcttcatggaagaatatgcttctcaaatgcaaatccaatcaagttatctccctgcttaaatccaaactcgctcatgtggcccacaaagcctaccttgcctgcctctctctaacctcacccaaaacacacttccattgctctctaggttccagcaccctgaccttttggtctgcactgtgccaggctccctccagccctgaagcctttgcacatgctgttcctcctgtctggaaaggctctcccatcttgtctattcgttctccaggctcaagtgactcttcctgagagccttctctgaccccagtccaggtcaagttcctctgtcacatgcctgaccctgcatccctccttgacagcacttatatcagcttgtaacacatttttgtgtgattattttgttaatgtcagcctctcccacaaactgtaagctcagtgagggatggaagcatgcctatttttaatcatcatggtatcctcagcactcagcacagcacatggtacatcaggaatgctcataagcattaatagagaaatgactgatttgagtcagacgaagactcagtatgccaggacgttcaggccgagagtctaagaggccgccggagggcttcggaaccagtgagcccactcaattcagcctgctcagtaccctgtgtgtactttatcaggaagaaggtacagtccctccctcccctatccgtttcccaaccacaggatcaaaataacccggaagcattacctttgcatcgagggtgagcagcaactcaaactcgttgtaaaactccttggggctgagcaacgggtactccttgactgtgcccaggaatgtcgcaatgtcgttcaaggcgatatcaaccccttctcgagactggcacttgtctacagcttgggaagccaagaggtagattcctgcctcacaccattggctgaccttttggaaagaaacagtgccctgtgcacttcgcctgaccacaactcagagccaccgtaatcctcagcaggtctgagcttgtaaggtgtctacaaggattcccagacaatgggaaattgtcatgggacggcatcgagtttaaggggtctaaccactgtaaattacactatgagggggacaaacccaaaccagctgatacctgtccacttctcagggaagtcactcggtcagcaaaatgagtctcttccattaacagtaattgctacatctccaggaggagacagctaaatatatatttaattaaagacagggtttcactctgtcacccaggctggagtacagtagtgcaattatggcttaatgcagcctggagaggtctaccccaggctcaggtgattcttccaccttagcctcctgagtagctgggactacagatgcatgccaccacaccaggctaatttttccttccttcctcccttccttccttccttccttccttcctctttctttctctctgtctctctttctttctttcctttttttgagacaggttttggccatgttgccgaggctgctctcgaactcctgggctcaagcaatcctcccacctcggcctcccaaagtgctgggattacaggtgtgaggcactgcacccacccagccttatagctaaatatctcttaggctggtctaaccatagagaaatgtaatcaatggcttttggggtttacctgctagtccactcttcttgcatccgaattggttaccagaacacagggtgattaataagacattagacctggcccttacatttcctgggagaagggcatgtcccttttaacaaaaacacaactttcatctttggattcccaggtgatccctatttgcatttactggcgtttgtctttcgtaaggaagcaagaatgcaaagctttgtaactcagcacagcgatactcaagagtttctggatgctgggaggacattagataggtgatgagttctaattattcaatttttaaaaaagactcattttctttgctcttttgaactccactgagacacttgaacagaaagacagggagcccttatgctacctgaagagttatatgaaaagaagtttccagtgccaatacctctgcatttccatttaccatgtgacctgaaaagcaatataaagtaactatacagagaaaaaagatcaaaatgcaacacgccaaagtggttgtctttctaagtgggaaaatgataggcaacttaagtttttgtcttatttttttcctagattatttacagtgaatatgtaccacatttagaataataaaaaatcataaagata

SEQ ID NO: 2013 - DNA, 3706 bp, Homo sapiens
  ENST00000287590
gcttggggagcctaggggccgtctcggagaaatggggtggtccccgccaggcggcggcggggcgggccctgggcgccgaaggggttaaggcacctgggccaccgcccctgccggcccctcctcccgcggccgggaagaggaaagtcgcggcgggggcgcggcccggtctccgtccccacccgcccgccgtcccgccggcccgagccgtggcgcccagagctgcgagccgctcgcccctccgccgctccggcccgggccgccatgtcgctgtggaagaaaaccgtctaccggagtctgtgcctggccctggccctgctcgtggccgtgacggtgttccaacgcagtctcacccctggtcagtttctgcaggagcctccgccacccaccctggagccacagaaggcccagaagccaaatggacagctggtgaaccccaacaacttctggaagaacccgaaagatgtggctgcgcccacgcccatggcctctcaggggccccaggcctgggacgtgaccaccactaactgctcagccaatatcaacttgacccaccagccctggttccaggtcctggagccgcagttccggcagtttctcttctaccgccactgccgctacttccccatgctgctgaaccacccggagaagtgcaggggcgatgtctacctgctggtggttgtcaagtcggtcatcacgcagcacgaccgccgcgaggccatccgccagacctggggccgcgagcggcagtccgcgggtgggggccgaggcgccgtgcgcaccctcttcctgctgggcacggcctccaagcaggaggagcgcacgcactaccagcagctgctggcctacgaagaccgcctctacggcgacatcctgcagtggggctttctcgacaccttcttcaacctgaccctcaaggagatccacttcctcaagtggctggacatctactgcccccacgtccccttcattttcaaaggcgacgatgacgtcttcgtcaaccccaccaacctgctagaatttctggctgaccggcagccacaggaaaacctgttcgtgggcgatgtcctgcagcacgctcggcccattcgcaggaaagacaacaaatactacatcccgggggccctgtacggcaaggccagctatccgccgtatgcaggcggcggtggcttcctcatggccggcagcctggcccggcgcctgcaccatgcctgcgacaccctggagctctacccgatcgacgacgtctttctgggcatgtgcctggaggtgctgggcgtgcagcccacggcccacgagggcttcaagactttcggcatctcccggaaccgcaacagccgcatgaacaaggagccgtgctttttccgcgccatgctcgtggtgcacaagctgctgccccctgagctgctcgccatgtgggggctggtgcacagcaatctcacctgctcccgcaagctccaggtgctctgaccccagccgggctactaggacaggccagggcacttgctcctgagcccccatggtattggggctggagccacagtgcccaggcctagcctttggtccccaaggggaggtggagggttgaggcctacgtgccactgggtgtggtggggtgcaggtagccagaaagggacctccctgtgtggataattctaggaaactgaggcccaggaacggttggagctgcccagtctggaggccctctctgaggagcgaggcgccaggccctggcagccctcctgacctgggtccgttgctggccccctcagatgtggtgggaggtcctggtgacctctggaggaacgctgtgctcaggtacctgggctaggcctggcctgatgggtctgtggccgcccctcgtcttcacagggaagagtcttctgtgaaatgcctcagtctccccagaggccgggcggccctggcaggagaaactcaaccctgtgcgggctcacaggcaccccccagtccacaccctggtctcctgggagagagggcccagccggctctccgcagccccaggcctgcctggagacgggccgcctctgccacagggcctccactcctggctgtgtcctgtaaggtctggaagggcgaccgctctgactacctcagcgcccctcagaatctccctggggctgcagccctaccccaccccgacacagggcagaagagcagcgctcctggccccccgaagtcccagagctgctgacccccaccccaggcaagtctctcccgcagcccccacacccccaggcctggctccctggctggaaagcagccggtttggccctggaagtggacattcctctattactgtgaagttttatttatgaagaatttggagggagaaggctccaggcttcaggagggggtggtgtcctccctggccctcctcccttccctcccctcattccagctgcctgccctcagcacccccaggcccctcacagcccagccccctccagagccctgccccaccgcaccctgcttctccagggcctagcagaccagcatctgccccggtgaagggatggatcagctgtgggggtgggtgcagaaggttgccacctcctacctcagcgggagtcacctaggaaagatggagggattgacactattttctcaataaaatgggacttttttttttttttttttttttttttggtgtgaaacttcctgttcccagctgcatcagagagcctgtctggggccaaggttgccagagatttctgaagacacagcttgttccttgttcttggctggtgggtgcacaaggacttctggaagggatttagacggggctgagtgctaggattaaagtggggatgggagtacggcaacagaaaaacctgggagctagcaatgcacccagcccttgactgtgccctggtggacagccgagctgtggctctagcgtgagccagtgccttcctgtccctgccaagggtgaggccagagttggccccgaggctaatgtttcagtgggtgagattaggtcggccgtacagaggccggtgggctccctgacatcccttccaggcaacctgaaagcactgaaatagcttatggccctgtgccagggaccttggcccaagctgctgacctccagggtggggagggagctacccccaggagaagagtcactcagacagcagtatgagcaagccagccagcagctccgtgcctgcacccagctcaggggaatcccagggggttcagatgcccaggaaggaaaaggggacagcgctactgctatggaatgagaccaccacttctcctgttgtccttcccagcttctccccaacctccccttttccctagtttataagacaggagaaaagggagaaagcaaaaagctggaaagaaacagaagtaagataaatagctagacgaccttggcgccaccacctggccctggtggttaaaatgataataatattaacccctgaccaaaacgactggtgttatctgtaaatcccagacattgtgtgagaaagcaccgtaaaactttttgtcctattagctgatgtgtgtagcccccagtcacgttcctcacgcttacttgatctattatgaccctttcacgtggaccccttagagttgtaagctcttaaaagggctaggaatttctttttcggggagctcggctcttaagacgcgagtctgccgacgctcccggccgaataaaaacctcttccttctttaa

SEQ ID NO: 2014 - DNA, 627 bp, Homo sapiens
  ENST00000479618
acatgtgatggagctcccgggcggcacagaggatcagagggtgccctctcaatgactctggctctgagtcacctaatgataccgatacctactgctgtgggaagaaaaccgtctaccggagtctgtgcctggccctggccctgctcgtggccgtgacggtgttccaacgcagtctcacccctggtcagtttctgcaggagcctccgccacccaccctggagccacagaaggcccagaagccaaatggacagctggtgaaccccaacaacttctggaagaacccgaaagatgtggctgcgcccacgcccatggcctctcaggggccccaggcctgggacgtgaccaccactaactgctcagccaatatcaacttgacccaccagccctggttccaggtcctggagccgcagttccggcagtttctcttctaccgccactgccgctacttccccatgctgctgaaccacccggagaagtgcaggggcgatgtctacctgctggtggttgtcaagtcggtcatcacgcagcacgaccgccgcgaggccatccgccagacctggggccgcgagcggcagtccgcgggtgggggccgaggcgccgtgcgcaccctcttcctgctgggcacgg

SEQ ID NO: 2015 - DNA, 4427 bp, Homo sapiens
  ENST00000578114
cgcagcggtttggaacacccctggctgtgccatagtggaggggattccctggtgtactttcacactccctgtagatcgggctcagccaggggagggacgggagcaggtgttctcacatggttgcaagtgggactgccatgtctgtgtgcaaggataagggtgtgctgctctctagatgtctcttgggaaatcatgctgagaggtctgttccccgcagcagtttgctgttctctagttccttaaagataattgattttaagtacttctgtagattgtatattgtagttttctcccagtgatagtgacgtatttcattccagggagaaagcaaaaggccttttttttttttttgtaactcttttctctctttccaagattatcccgaaggcaataattcaagtgattatcttgttcaaacaacaacgtatctcccggaaaacttcacatactcaccatacctcccctgtccagaaaagctgccttatatgcactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacaggtatgttgagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaacgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaagtatcttcatttaaaaagaaatcaagtcagtttttttaaaagaatgatctatggaagaaaacccaatagtacttataatatacaaatgaattatactattagataagaattaaatattctatttttataaagataaatacttagtagataaaaacaaattttaagtttagttttcagacatagaatttcacttttggaggggacccttgaatgttagtttcattcaaactatattttgtttttttcacttttaagagattatatctctggtgttaattactaaaattttctttctaaaagtataatttaatagaattatcttaaaatacatgatcagtattcagtgcgctgatattataatgtcttctatatgtagtatctaaaagcataatttaatagcattgtcttaaaatacgtgatgagttatttggtgcactgatgccataatgtcttctatatgtaatatcttacatgtttgcatgagtgtcagggctttgtccagttatcttcatatgactgttctctgaaaaaaggtcttactacctgatatcaagtacatatcttaattttggatgaatttttccacagtaaagccgaacagtattcttttttgaaaattagcaattataaagattgtttaaaatatcttgatattttcacaaattttaaacaaaaaattaaatatctataaagtgaatgttcaacaacaatgatgagcaatagaaatctatatatgagaaacgtttggataatatttgcctcaaggattgtttacctaaaacagaactatggttatttatctcagattgtaagttttattttgaagtgtcatttttatggcaatattgataacacaaatgaccacaaactaaatcataaaataattgaatccttacactttgagaaaatggatagcttctgtgttatgataccaaacaaaatattttcatatttatttcttagaactatttccaaaatatttatatttcagtttttttatggtactcgaaaaatcaaaccttctgaaaattatgatatttgtacttcatttgtgtattagttcattttctgtttctattacatagtttttaaagtcaatgaaagagattgagaatgttaacatttgttgatcaatgtggagctgtccacattcggtatcttttcatttttatatatattttacagtttcaagaaaacttagtactactagtatctgccttattttcttaagtctgatgttaatttttgtttcaggagtgagatataaacattttgctttttttcagttttgaaatatagtttgtcatcctgtgaaaaccacctcgtttgctttttgtttgtttgttttgcttttttagtgtagacctaaaattatttttgcctataaacagtgaacttaatatgtttctgtgagagtgacagagctgtgcccgtttatcttcattgtattaattattacataaagattaacaaatacattgcaaatgcaaattataggatgtttggaggatttattaatgagcatgtattgattgcctattccatatccagtgcaatgctaggtatgtctatggaaggagtattattacttcatttctaaacaaatgaagtcaagcaaattgagatctttctgaaattatgaagacatcttctgataacttatctgttgtatttcctagtctcaaagtcaagaaacccgtatatgtggacctagggctaataggaggtccctatggcactaactgggaaaattacatggtgcttttcaactacagaaagaagtaatgactaatgggcctgtctgtagagaagaaaaggagaagagtacacatttgctggaactatatataattcacagtggagatagttaattctttgctaaaactagggttttatgagtattttttaaatctacatttaagtttttgtttttgtgaaaagttattcagtaagaaaactttataatattaagtagatacagttatgtattaaaaatttccttatatacccttttgccagccaagatactgatattttaaaacaaaatggaaaaatgtccaatacaatattctctttctggaggcttcctacaagtgaaagcagattttgtcattttatttggcctttgcttgtctttgatatatttctttatgtgtttttcaaatacatactgttgtagatttattgtcttgtatttgcaagtatgccggttgagagaactaaaatggttatagtattgtttatcagaaagaggaagtgtacttaagattattttatttatttagatgaaaggcttctacataaatgcactgaaataaatgctagtaatttcttgtatcccacttctttttttgcttctcatggaaatgtttgtacttttttatcattgtcttttatgaaatataatgttctaaag

SEQ ID NO: 2016 - DNA, 3891 bp, Homo sapiens
  ENST00000306851
ccggctttcttccgtcctgccgtccccgggcccctagcccccagtcccctctcccccctccacctcttgtccctcggcctccgcgcctcccctcccccgactctctggcctcccattcattccgtccgctccctcccatttcctcttttccgctcgggccctctccccagagcctccccgcgcggaccccgctgcagtctcggggttctcagcacatttatggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcgccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaaggtggcagttctcattcctttccgtaatcgccatgaacatcttccaatttttttcttacatctgattccaatgctccagaagcagcggctggaatttgcgttttatgtcattgaacagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaacgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaagtatcttcatttaaaaagaaatcaagtcagtttttttaaaagaatgatctatggaagaaaacccaatagtacttataatatacaaatgaattatactattagataagaattaaatattctatttttataaagataaatacttagtagataaaaacaaattttaagtttagttttcagacatagaatttcacttttggaggggacccttgaatgttagtttcattcaaactatattttgtttttttcacttttaagagattatatctctggtgttaattactaaaattttctttctaaaagtataatttaatagaattatcttaaaatacatgatcagtattcagtgcgctgatattataatgtcttctatatgtagtatctaaaagcataatttaatagcattgtcttaaaatacgtgatgagttatttggtgcactgatgccataatgtcttctatatgtaatatcttacatgtttgcatgagtgtcagggctttgtccagttatcttcatatgactgttctctgaaaaaaggtcttactacctgatatcaagtacatatcttaattttggatgaatttttccacagtaaagccgaacagtattcttttttgaaaattagcaattataaagattgtttaaaatatcttgatattttcacaaattttaaacaaaaaattaaatatctataaagtgaatgttcaacaacaatgatgagcaatagaaatctatatatgagaaacgtttggataatatttgcctcaaggattgtttacctaaaacagaactatggttatttatctcagattgtaagttttattttgaagtgtcatttttatggcaatattgataacacaaatgaccacaaactaaatcataaaataattgaatccttacactttgagaaaatggatagcttctgtgttatgataccaaacaaaatattttcatatttatttcttagaactatttccaaaatatttatatttcagtttttttatggtactcgaaaaatcaaaccttctgaaaattatgatatttgtacttcatttgtgtattagttcattttctgtttctattacatagtttttaaagtcaatgaaagagattgagaatgttaacatttgttgatcaatgtggagctgtccacattcggtatcttttcatttttatatatattttacagtttcaagaaaacttagtactactagtatctgccttattttcttaagtctgatgttaatttttgtttcaggagtgagatataaacattttgctttttttcagttttgaaatatagtttgtcatcctgtgaaaaccacctcgtttgctttttgtttgtttgttttgcttttttagtgtagacctaaaattatttttgcctataaacagtgaacttaatatgtttctgtgagagtgacagagctgtgcccgtttatcttcattgtattaattattacataaagattaacaaatacattgcaaatgcaaatta

SEQ ID NO: 2017 - DNA, 2128 bp, Homo sapiens
  ENST00000237019
ctcgggccctctccccagagcctccccgcgcggaccccgctgcagtctcggggttctcagcacatttatggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcgattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaaggtggcagttctcattcctttccgtaatcgccatgaacatcttccaatttttttcttacatctgattccaatgctccagaagcagcggctggaatttgcgttttatgtcattgaacagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaacgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaa

SEQ ID NO: 2018 - DNA, 1239 bp, Homo sapiens
  ENST00000383131
atggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcgccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagt

SEQ ID NO: 2019 - DNA, 339 bp, Homo sapiens
  ENST00000579372
aggggggattcattaatccaggtcggaaatacaccttgttcctcgaggattttggaaggaaattccacccgcgaagtccccttttggagatgcccttttcctttcagccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcg

SEQ ID NO: 2020 - DNA, 9113 bp, Homo sapiens
  ENST00000257749
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcgttcgttcacatagctcccagttttaacatttcgccacctactgaagacatcatttgggaccaagctgatgagcccttgaagcacagcagataagagtgttgctgttgatcatctttgcctgggaagttgaatgataaagccagaagaaagcatgctttctgatcatttgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtaccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaatatatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtgttgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctatcaccgggaaccctccctgtccccttcccgaatcacacacataccctaccctcacctgatgataattttctcttcttgctgcaaaactggttggcttgcaacccagagagagcagcttcccttggctctggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaaaaaaggcttttctttttaaacagttccacttttaaaacctgcctctgggtttttgttttttcttgtttgtgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactggtgacagtgagaatataaactcaatgtgaatcacgtgatacttcgcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatgagttagtgtttcttccccaaactgaagactgtgttggaagtgcaatttctggtgagtcagtccacaatacaatgccctgtgtggagttggtattcatacaggaaatctgtgtgcacgaggcattgtgtgttgaaagtgtatgtttatagtactgcctgagccatctcatgaccccagcgtccaaaaccgatgctgtagaacagaacatatctgtacacaaatagtgtgtgcaaatagcatttgtacatagaaaagtctcattgtggcagattgagcataaattattcaactgacggtgcaaaaacattacttgcaaagaaaagtttatagtattttcctacactccaccctgggagatgatatttctatcaaatgaatatcagtgcattttaaatgtaatatgaaaacgatgctgccattttgtgaagaatacccacttggttgcagaggccaactttcatagctttgatttaatgttgtgacacggtgtatgcattttgctgtcaagcaatggataaacagctctgactttcattctcattccagtttattgacctcagataaaacactggcccttcttagaagcagaagtgtgcaccaagaccattcatttcaggtagactcacattcagtgccaagtgctcccatgggaataatcagacgcatatgttgcgaaagagtgaagggacttggacaaagaggggttttcctacagatggatgctcagtcttctaccaaaacatgtttggaggcagaactatgacctccccttaagtcctaacaatgtattttgtgtgtgcaaatcctgggatgcccgtttcacgctctgacataaagacatggcacctctagtgagtgatcaggaagattccatatgcatttgggagcttcaggtgcttgttagacacagtgagccattcaaggcaagcaccacctttgctagtgaggccaagagagcctgtgacaatttgacaatttgttccagaaccagtctgatgcaagtgcacctctaatatatgccttacaaactccagaggccatattcaaaacagggtcttctcagtgtatgcaaggggctgcagcccctcttctcttcctccccaggttgaacaatacggacagttttcacacatatctacctgtataaccctctgtacctctcataactggtcaacgactgtaacaggttacatcaggtgtttttctacatactttttacacagattctatgcgattaatgtaatttaattcaatgcatcattttattgtactagttcttaggcttgtccttatttttttctaagtgattgtggtttttctcgtggtttttattgtaaaaaatgaaaggctgttgatgcttattctctgtaactaagaatttttaccttttgggggaaaaaagcattgctatgaactaatgaattgaaacttcatttactcattgtaaatacactattgtgcaaaaaaagttttcactcaattgaattgctagtgttaactgaattttgtctagacaccatttctgttgatgaaataaagacatatcattatgcattgtaaactg

SEQ ID NO: 2021 - DNA, 3981 bp, Homo sapiens
  ENST00000343122
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtaccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaatatatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtata

SEQ ID NO: 2022 - DNA, 395 bp, Homo sapiens
  ENST00000481150
gcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggagatggtgtaaggatcactagatttcccttgagagtaaaagatcgaaagcattcacagcaccttctttgcttgggggaaaaataaaagcaactagtaattttcaccattaattcagtaagattctaagaagtgtaaacttgcttttctcaccgttgttgaaaacagcccac

SEQ ID NO: 2023 - DNA, 780 bp, Homo sapiens
  ENST00000406998
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggag

SEQ ID NO: 2024 - DNA, 868 bp, Homo sapiens
  ENST00000453877
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcgttcgttcacatagctcccagttttaacatttcgccacctactgaagacatcatttgggaccaagctgatgagcccttgaagcacagcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggag

SEQ ID NO: 2025 - DNA, 618 bp, Homo sapiens
  ENST00000470301
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcgttcgttcacatagctcccagttttaacatttcgccacctactgaagacatcatttgggaccaagctgatgagcccttgaagcacagcagtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacat

SEQ ID NO: 2026 - DNA, 436 bp, Homo sapiens
  ENST00000493201
ccaaacaaagaccacactgttgacagcgttgggttccagtagcggtaaactaccaaggggctggtttacagaaaatgagtttgctctgtgatgtcatacaagtttgctttgtcctgacgccaacatgacactgaggcagcagaggagggagaacaggaaaattggaaccgtactcttagttaatggtttccagagattatttagcaggacttgaacagagggaggaaaatattgtgaaggattgctgcgaggtgtaccataattgcgtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtc

SEQ ID NO: 2027 - DNA, 498 bp, Homo sapiens
  ENST00000472023
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagataagagtgttgctgttgatcatctttgcctgggaagttgaatgataaagccagaagaaagcatgctttctgatcatttgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaacttt

SEQ ID NO: 2028 - DNA, 540 bp, Homo sapiens
  ENST00000494747
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcgttcgttcacatagctcccagttttaacatttcgccacctactgaagacatcatttgggaccaagctgatgagcccttgaagcacagcagtgcagctgtctgcttcagaaagtgagggctccaggaatgaggagaatcttcaagaacttcctcgcactgtgacatgtctgatcccttgctcccatccctgcagcatgaacaagaaaccgctcctgcctcaactccaagggccagagcgagttggcacaccctccaagaggagcacctcgcttct

SEQ ID NO: 2029 - DNA, 9108 bp, Homo sapiens
  ENST00000537989
gtcaacaatgtagcgattgagagtgtgggcgttccggggagagcgcaagccgcgcggcgcggagcaaacagcgccgagccgccgccgcctcagcagcagcagcagcagcagcagcggcagcagcggccgtgcacgcccgggctgcggtcgcacagcgctaacgtgagcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtaccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaatatatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtgttgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctatcaccgggaaccctccctgtccccttcccgaatcacacacataccctaccctcacctgatgataattttctcttcttgctgcaaaactggttggcttgcaacccagagagagcagcttcccttggctctggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaaaaaaggcttttctttttaaacagttccacttttaaaacctgcctctgggtttttgttttttcttgtttgtgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactggtgacagtgagaatataaactcaatgtgaatcacgtgatacttcgcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatgagttagtgtttcttccccaaactgaagactgtgttggaagtgcaatttctggtgagtcagtccacaatacaatgccctgtgtggagttggtattcatacaggaaatctgtgtgcacgaggcattgtgtgttgaaagtgtatgtttatagtactgcctgagccatctcatgaccccagcgtccaaaaccgatgctgtagaacagaacatatctgtacacaaatagtgtgtgcaaatagcatttgtacatagaaaagtctcattgtggcagattgagcataaattattcaactgacggtgcaaaaacattacttgcaaagaaaagtttatagtattttcctacactccaccctgggagatgatatttctatcaaatgaatatcagtgcattttaaatgtaatatgaaaacgatgctgccattttgtgaagaatacccacttggttgcagaggccaactttcatagctttgatttaatgttgtgacacggtgtatgcattttgctgtcaagcaatggataaacagctctgactttcattctcattccagtttattgacctcagataaaacactggcccttcttagaagcagaagtgtgcaccaagaccattcatttcaggtagactcacattcagtgccaagtgctcccatgggaataatcagacgcatatgttgcgaaagagtgaagggacttggacaaagaggggttttcctacagatggatgctcagtcttctaccaaaacatgtttggaggcagaactatgacctccccttaagtcctaacaatgtattttgtgtgtgcaaatcctgggatgcccgtttcacgctctgacataaagacatggcacctctagtgagtgatcaggaagattccatatgcatttgggagcttcaggtgcttgttagacacagtgagccattcaaggcaagcaccacctttgctagtgaggccaagagagcctgtgacaatttgacaatttgttccagaaccagtctgatgcaagtgcacctctaatatatgccttacaaactccagaggccatattcaaaacagggtcttctcagtgtatgcaaggggctgcagcccctcttctcttcctccccaggttgaacaatacggacagttttcacacatatctacctgtataaccctctgtacctctcataactggtcaacgactgtaacaggttacatcaggtgtttttctacatactttttacacagattctatgcgattaatgtaatttaattcaatgcatcattttattgtactagttcttaggcttgtccttatttttttctaagtgattgtggtttttctcgtggtttttattgtaaaaaatgaaaggctgttgatgcttattctctgtaactaagaatttttaccttttgggggaaaaaagcattgctatgaactaatgaattgaaacttcatttactcattgtaaatacactattgtgcaaaaaaagttttcactcaattgaattgctagtgttaactgaattttgtctagacaccatttctgttgatgaaataaagacatatcattatgcattgtaaactg

SEQ ID NO: 2030 - DNA, 1157 bp, Homo sapiens
  ENST00000394532
gggcttggggtgagacctgtgcgccgtcaccacgggcggggcggggcctgggtccaccggggttctgaggggagactgaggtcctgagccgacagcctcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgcc

SEQ ID NO: 2031 - DNA, 929 bp, Homo sapiens
  ENST00000309032
cggcaggcccgggtcaggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgc

SEQ ID NO: 2032 - DNA, 525 bp, Homo sapiens
  ENST00000544785
catgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacag

SEQ ID NO: 2033 - DNA, 631 bp, Homo sapiens
  ENST00000394531
ggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggagggagaacttcgtattctccttcttgggaatctgaggactctgaaaatcccagtgcagggatgctcgcggaagcatcagcagggatgtccgccccagccgctgactcagaagcccaacacgcagagaatgtaaagctagaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcct

SEQ ID NO: 2034 - DNA, 325 bp, Homo sapiens
  ENST00000493798
ggcagggccaggggcttagaggagctgagattaacgtcgcccccctacccactgaccctctgcaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcga

SEQ ID NO: 2035 - DNA, 359 bp, Homo sapiens
  ENST00000492141
ggacacaggctaagagagtcgaaggctggctagacaaggggagagacacagagctccgctgatcatcactggactctggattccaccaaacctttggaaccttccagcctcaggcctccacagcttcacagaaactgggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggc

SEQ ID NO: 2036 - DNA, 552 bp, Homo sapiens
  ENST00000544271
aactagggcccggagcccggggtgctggagggaggcggcaggcccgggtcaggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggagggagaacttcgtattctccttcttgggaatctgaggactctgaaaatcccagtgcagggatgctcgcggaagcatcagcagggatgtccgccccagccgctgactcagaagcccaacacgcagagaatgtaaagctagaggtgccatgctggggcctggggcacttctagccacagccactaccctccacttccacacccagctccgggccaggctctaggcggatggcaagagtgggcaggcctgggcacccacccacgttcacacccaaggaggagccaca

SEQ ID NO: 2037 - DNA, 2571 bp, Homo sapiens
  ENST00000369085
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtacaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 2038 - DNA, 1146 bp, Homo sapiens
  ENST00000450186
tcatgtggcacatgtgataccatgtgaggtatctggtgttactaagtcgtcacgtatttcgatgaagggtccacaggctcagaaaagatggaacgagtgactgtggagaagggtagaacatgggcctgcccagagcgcgaaggcagatacagaagagctgcccgtgaaggatgcaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccct

SEQ ID NO: 2039 - DNA, 1939 bp, Homo sapiens
  ENST00000321280
aaggtggccgccgccggacgccgggctctgtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgag

SEQ ID NO: 2040 - DNA, 593 bp, Homo sapiens
  ENST00000576470
tctgtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatggtgagtccacccccagcgtggccctgcgaggaggggcaggtgcgacgggagagctggcgccacaccttggccgtgtgtccacttgggaacagtcccagttgtccagccacactcggaggcagggagggaccctggctcagcacacaagccacactcgaaggaggacgtcggagaaaagggcacaggccagaccgcggccgcatgttt

SEQ ID NO: 2041 - DNA, 584 bp, Homo sapiens
  ENST00000575750
tgtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgccctgccctgcctcctgttccgggtccatgtgttggagctgacggctgatgtgttttctctccatgtccagctgaagtcttttcacaacgagctgcttacgcagctggagcagaaggtggagctggactccaggtatctgagtgctgcgctgaagaaataccagactgagcaaaggagcaaaggcgacgccctggacaag

SEQ ID NO: 2042 - DNA, 559 bp, Homo sapiens
  ENST00000570913
gtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggtctagcctggggcagacaggagatggcagatggacacctgggaggggctcactgagctccgcctctccatcaacggaggccccgtctaggttgtggaggatgcttgagagagccctgatgttctgacctcccaaaaggtcaagggtgctggcagccggtgagacgccgcagtttgctctgctccccggggctgtgcttgccaggagacatttcggctataagcaggcgagaatacct

SEQ ID NO: 2043 - DNA, 565 bp, Homo sapiens
  ENST00000575989
gtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtggaactgcgcccgggccccgtggggtgggagctgcctcctgagctggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtca

SEQ ID NO: 2044 - DNA, 2133 bp, Homo sapiens
  ENST00000572329
gtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagagggtggaagagaagtaccagcggaacctttttcctattttttctccttctgcgctgaaaccagaaagcaggaactttcgtggtgagagttggcaggggaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatctt

SEQ ID NO: 2045 - DNA, 2095 bp, Homo sapiens
  ENST00000428708
gtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgca

SEQ ID NO: 2046 - DNA, 2512 bp, Homo sapiens
  ENST00000575712
tcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggtaaggggactttcagacctgtctttgggaccgtgggtgggtgtgaagaggccgggtggggcaggtccctctgctaggacctggggccacctcttttcctttagggcccagcctggcccttcacccctgtcagagccggggatgtcccttagggcgtcctgctttctccgagtgacacgggaacccccctgggccctgcccctctttcatcgcatctggccggccccatccatccctgtcaggcaaggttggggagggtagctgaggctggcatccatggctggggctgcagcctcctctgccccaatctgtgctccgcccttgtcctgggtcttcctggagggtcaggaggccaacgggagctgctgaaaggggcattgctcggtgctggcggactcgccgcctgtggctgggcagcgtcgtgcagccaggcagccgtcctgtgctttgtttcacagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatcttaaaaaaaaaaaaaaa

SEQ ID NO: 2047 - DNA, 2229 bp, Homo sapiens
  ENST00000575245
gggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagagggtggaagagaagtaccagcggaacctttttcctattttttctccttctgcgctgaaaccagaaagcaggaactttcgtggtgagagttggcaggggaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagcgccgatgtggaagtggccagattctgagccgcctgactagagaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgca

SEQ ID NO: 2048 - DNA, 2129 bp, Homo sapiens
  ENST00000435091
ccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagcgccgatgtggaagtggccagattctgagccgcctgactagagttagaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgc

SEQ ID NO: 2049 - DNA, 2879 bp, Homo sapiens
  ENST00000321300
ccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtgtgatctgtccgcccaagggccagaaggccgggagcacggggatgggagcgcccgcaccctggctggaagatgaacttcccgtaagcacgtaattccctgcaggtccggcagctacacctggagtgtggggcctggtccctccccatgcccctcggtggggctctcctgggcccctcactcccactggcaatgtcacaagggcctccccaggcccctcctgcctcgggcaggccccagccctcctccttacccaacctcccatccagaaccttgctgccagggcctcccagctcgctcctgcggccaaaggccagctgtcaggtgctatgcggggtcaccagcagagtgcccgctggcaggtgggggcttccccgcttccggggtctgccccaggactcctgggtggacctcccccccccacctccgctgactcctgcaggcactggggagctctgctggaattgggggttttaaaacttcattagcagatttgtgctcttccatactgtttgtttgtttgttaggtgaaatacagtgtggtgagctgcactggtgacaacagcccttacctggctggggaggtgtctccagcagagctcactcccgcctacagccactcacaccccggggacaggaagctgtagagttggcgggccaggagggcagttgagagctggccagcggagggtgcagggaagcccagctgtgctcaactctcctgcctccgccttccaccctgggcccagggacagacagacattgccctcagaagggcagggaggaggctgtcctggagaggcctgtaggtccattcttcacccgtccctaccaggccaactcggcctgcaggaagggagacctgcagggcgctacccctgcgcccccacacacagtagggccagaacaccatcccctccaccggggtgtgccgaggacagtggggaggagaggagaggggcagcttcctcctggccccaggaagggctggcatcgggttcctggcacagcccctcctgtccaggactttatcatcggcagacctcagaagacaacacacaaaggtttcttttgtcttagcttcatttctcttaaaaaacaaggaacaagaaaacattgcaccagcgttctaagcctcaaacaaaacacaaaacaaatccccctgcgaagcaacaataaactttacatctctttggcaacaat

SEQ ID NO: 2050 - DNA, 657 bp, Homo sapiens
  ENST00000573894
gtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagggctggccactcgagggaaggtggtacttcaggttcctcgagggagcggcttcggtgttgtttctctcaccgtcccgccggcgtcaccg

SEQ ID NO: 2051 - DNA, 581 bp, Homo sapiens
  ENST00000571530
ctttgcttcagatgtgttaagagtggcatccacgttctcgtctgcgaaatgacagagggtggaagagaagtaccagcggaacctttttcctattttttctccttctgcgctgaaaccagaaagcaggaactttcgtggtgagagttggcaggggaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaagg

SEQ ID NO: 2052 - DNA, 574 bp, Homo sapiens
  ENST00000573017
agttgtattctgcctgctgcaccatgcaaatgcgctccttcagcccgcagacactcctctgcggccgggtttcttcttaccccctttgcacagaccatcatggagcagttcaaccctagcctccggaacttcatcgccatggggaagaattacgagaaggcactggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtc

SEQ ID NO: 2053 - DNA, 626 bp, Homo sapiens
  ENST00000572918
agttgtattctgcctgctgcaccatgcaaatgcgctccttcagcccgcagacactcctctgcggccgggtttcttcttaccccctttgcacagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgctt

SEQ ID NO: 2054 - DNA, 567 bp, Homo sapiens
  ENST00000575958
gtcttgcacattgcagactgacgatggcttcctttttccagagccactcgtctgtgggacacttggtgacctcatctacggtagagtcttccgtagccctcacgtggctctccgaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgctt

SEQ ID NO: 2055 - DNA, 578 bp, Homo sapiens
  ENST00000573659
gagatgctgggaggcccctcaggcggcggcaataccaagtaatgcctttagcctcctttgatcagctgtgacgggcgtcctggtctgagactgtgaagcaattggaaatagttctcccactccaggctcagcttggggatctgtggggaaatggcttcctactgcccagctctgcagtttccttgcccagggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagg

SEQ ID NO: 2056 - DNA, 782 bp, Homo sapiens
  ENST00000572073
gcaatttgacttgaatagctcaggacctgaactggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgccca

SEQ ID NO: 2057 - DNA, 646 bp, Homo sapiens
  ENST00000573677
agaaatcacagcgagtcgagtattctcccagcttgtctgggcaggagacagggttgggcctgtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagc

SEQ ID NO: 2058 - DNA, 631 bp, Homo sapiens
  ENST00000574804
gcgagtcgagtattctcccagcttgtctgggcaggagacagggttgggcctgtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcg

SEQ ID NO: 2059 - DNA, 542 bp, Homo sapiens
  ENST00000576364
tttggttgggtgttgagtttgtttcctgttcttcctcttcagccccggggacgttgctcatttctggtcaccttctcctccagctgtccttgctgccccaggatgggaggatggaaggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaag

SEQ ID NO: 2060 - DNA, 575 bp, Homo sapiens
  ENST00000574688
agtgctcagagggtctgtggtcatggtgagaagaaccccgcagctcctggaagggcgagaggacccggagaggcttcctctgccagactcagctgtgctttgaggaggggaagtgacccaaggccagcccagccgtggtcctgggaggcagcatcgcccggttagggcttcctgcgtgtcaccgggggccttgctctggtttctggctgaacttgttgggcactgggcgatcctagtgggggttctgctcgctggagcgagaggaccctctggggcgtgggaccggcggtggcctggacgtcagcagaggaggaaagtcctgcttcaggcagccattcagggagggacaggaatcacccgagagtgacctgccagcagcaggggcggccctcctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccaga

SEQ ID NO: 2061 - DNA, 1014 bp, Homo sapiens
  ENST00000577097
aggacagccctgaggggctgtggcatgcttctgtcccatgtggtgctgatggggggtgggtctcgggctctgctgatgagtatcagggctgggtcctggaacccaggctggctgcactctgggggcgcttctggggacggctagccagccccctgggctgatggtgtggtcgcacctgctggccttggcggtcatgtctcaaatgggatcacagctccgagggagctttggcagaggaaggtgggaaacatctgggtgaaaaggaagtgggccgtgctcctgtgtcttcgaggcctcggcccctcagctcctctctctgtgcccctctctttggtggaagcaggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtgggggtgagtctgtggcctctggaaagc

SEQ ID NO: 2062 - DNA, 2316 bp, Homo sapiens
  ENST00000576225
atgtttcactggctgcagtggcagccatgacacgctgggctccagggagagtcctgatcgcagccccagccagaccccactcctggggttcacaaggttgcaaggcacacttcccctggcctctccgactgtaggcagaggcagaccccacacaaccagagcacgttgctggcggctggtttgcagcatcctgtctaaagccaggggtctgaccctggtgtcagttcaggcccatgggccctgcgacctctcagcctgtgtcgcagtgatccccagcatgggacagcagaggaaggaggggatggccgtttgtttcccttgtggctgtttggaggcgagattgtccgacgttccagactcctgttcagcactcgctcctggctccagagggtgcacacgggcatgcggggccacagctcatcagtcagggggagggggcccctcctgcacagccgggacacccggtgtctcgtgcccatccgctctagccctgccctgcctcctgttccgggtccatgtgttggagctgacggctgatgtgttttctctccatgtccagctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagcgccgatgtggaagtggccagattctgagccgcctgactagagttagaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgc

SEQ ID NO: 2063 - DNA, 509 bp, Homo sapiens
  ENST00000575841
cagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgc

SEQ ID NO: 2064 - DNA, 604 bp, Homo sapiens
  ENST00000574027
gtgcccccgctccctgcttaactgcagggaagccaagcaggtctgcccacaccctgcagaccaagccagaagatttccagtgtggggtcgcctggtggagctggatcggccccaaaggagaggacgggactaggccaggggcagatgagaaggataagtgagagtctgtggaaacagccatacgggggagctgggggtccctcgggtgcccgctgctgtttgcagcctcccactcaggcatgcttggtgcacagttgcagggacgcaactcaggccgttctctagggtgccctgccctctccagccacctcttcccgtgtccccagcctttgttttgatcctgtttttcactccagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagca

SEQ ID NO: 2065 - DNA, 748 bp, Homo sapiens
  ENST00000576756
gcatcttcttaagagccgattctgaactgaccactccttgacgggcaatcccggtggacggggggtctgagtcctgctgtggagggtctgcctgaggccggtaggggctcagcccaagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgc

SEQ ID NO: 2066 - DNA, 1442 bp, Homo sapiens
  ENST00000416299
atgctcctcccagagggacagaggcagagagccctggggtttggaactgtcacttccacctacagccctgttggtcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggtaaggggactttcagacctgtctttgggaccgtgggtgggtgtgaagaggccgggtggggcaggtccctctgctaggacctggggccacctcttttcctttagggcccagcctggcccttcacccctgtcagagccggggatgtcccttagggcgtcctgctttctccgagtgacacgggaacccccctgggccctgcccctctttcatcgcatctggccggccccatccatccctgtcaggcaaggttggggagggtagctgaggctggcatccatggctggggctgcagcctcctctgccccaatctgtgctccg

SEQ ID NO: 2067 - DNA, 858 bp, Homo sapiens
  ENST00000572498
gcccaaatccctgtctcctccgcagtctcagagcaagctcagcgactcctactccaacacactccccgtgcgcaagagcgtgaccccaaaaaacagctatgccaccacagccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagaccca

SEQ ID NO: 2068 - DNA, 3689 bp, Homo sapiens
  ENST00000576995
ccccagcggcaggggtctccccccagtggcaggggtctgccccatggcaggggtctttccccacggcaggggtctccccccaatggcaggggtctccccccaatggctcgggtctcccccacatggctgttgtcttcccccatggctggggtctttcaccacagagtctagtgaccaccttgctccatcgcctccctgtgccactcagattgccgcagggtgtggcatcccacacgtgtacacactcagcacgtccagccgaagccctgtggtgggcatcagtttcccacagttcgcaggtgcagagcagggcttggccatcctgagaccgcaggctttctgtggctttcagctcttccacatgccagacgggctctccagtttggagttctagaagtcacctatggagtcagatgggccacacctcctcagtttactgaatgctgttgcagagaggctgggccagggtgccaccctcgctggacctgggggctgcattcccagggctgtgtttgtgcgggtgtgtctcttggcaagatgggaaaaggccctgacatttgtgccttcctaagcttggccttgcagccatcactctgaggagggggccgagggcagggggtctcccaggaggctgctccatctttcttccagtggccactccaatcttggtgccatccgtggcttagcgtgacactggggctgcgaggcaggagcaactgctctgcccgggctctggggccttgcagttgggtctggtggggccggcagctcccaccaggttgaggacagcccgggccaccttgcccttgaggctgagcacacagtgggagcgggctgcggtctttgtctccctggagcactgtctctgttgctccagagacagccgcgcagccatgctggggagctagagggacttgtgcatggatggtggtcggtgggggatggggagcctctgggctgagcgtggctcttacctggggcctctcttccaggcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccaggtcagtgggcggggccggggctgggaggggcccgcaggtggaacagtgggctcagcctgcagtcccccgttggagcctccgctgaggggcggggcgcctgggggtctgggtctttggacagccctggggtgaaggctgcatgatttgggaatgtgtacacacccctgcttcggcctcaggctgcccgcctcgccgcagcaggctccctgtgtcggcatgctggggctggggtcagcctgtccctcatggtgccctcagccagccacgggcaactcactgctctgtccaagggggcagcgtctgggctgggaagtggctggcctagaggtgggcctggacgccgccgccttttgggagagccaggggggcaggatctcttccgtgagaaccacggggctccctcagtcacatccatgagatgggagtgcttgctgctcagccctggcatgtggctggaccccttccagtcagtgtgaccctggatttgggccatctggtgccgggaggccagaggtggaggatcagggcctgggtcctaggccctggtgtgggttctcggaaacccgggatcatggcggtcctggtatctaggctggggcagggtgtgagcgtgcatctcaacttgccgggttccagcccgctccgtccagggaggctcctggggttggagagttggagacccctgtctgtctggggctcctcagccagaggtccagtttgtgggatattggctgggctagcagctttgttcccggggccggtctccagggctgggcctcaggcagtgagtagagagaagaagagaacccacctttttccgagataacaggtagcctgggtgactactcagctattgacccacaagtgaggagtccctagattgacagcctgagctgaggccgcaggaggcaacctggagaggtttgggctctgggccgtgggtgttccacaggtcagcctctggggtgggctcagtgctgggagagccaaggaggggtctgcatctgccctaggccgcgggccaggccatgctggcagatgaagggcacagccagccccagcgccacacctgggcgctcctcccaggcagtgtcaccctcccaggggccgggatggtacatgtgacaagtttccaggaaactgcagctggggtctgggtctggtcctgggtcctacaagcaggcggaggagtcccaggggcccgcccaggcatgggtgaggtgctgcaggtgccctgcgggggcctcggctccctgggggcaggaggaggggtctcaggcggccagtcttgcatctgtttgggagtgtgcaacaagcacacaaattgaggtggccgctggctggaggaggtatcccctttaatttgggcagtcattactttaccactgggaccagggctccaggcaggtctctgagtgctgcagccaggagatggggagccttccaaaggaacacggtttgaaccttgtccaggcaggatcaccatttgtgggtgtgtacaggcagcgggtgggggtgaccacaggccccgtcacccggcctgacatgtttctgcctctgcccccagggcctggatgactatggagcgcggtccatgagcaggtaaggggactttcagacctgtctttgggaccgtgggtgggtgtgaagaggccgggtggggcaggtccctctgctaggacctggggccacctcttttcctttagggcccagcctggcccttcacccctgtcagagccggggatgtcccttagggcgtcctgctttctccgagtgacacgggaacccccctgggccctgcccctctttcatcgcatctggccggccccatccatccctgtcaggcaaggttggggagggtagctgaggctggcatccatggctggggctgcagcctcctctgccccaatctgtgctccgcccttgtcctgggtcttcctggagggtcaggaggccaacgggagctgctgaaaggggcattgctcggtgctggcggactcgccgcctgtggctgggcagcgtcgtgcagccaggcagccgtcctgtgctttgtttcacagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatctt

SEQ ID NO: 2069 - DNA, 1877 bp, Homo sapiens
  ENST00000375533
cgccgctcggagccgccgggcaggtcccccagcgctcgcgtctgggcccgccccccgctgcggggcggattgacaggagcccggcggccaatcggacgccgtggggcggggcgaggcggggcggtgcaggccggctcccggcgcggggcgctatttacggcgcggagccggagagacctgggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgctgacggcgcccgccgctccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgcttttaaaattataaaaagcaaagagaagactttgtacacactgtcaccagggttatttgcatccaagggagctggaattgagtacctaaataaacaaaaatgtgccctatgtaagcttctacatcttgatttattgtaaagatttaaaagaaatatatatattttgtctgaaatttaatagtgtctttcataaatttaactgggaaacgtgagacagtacatgttaattatacaaatggccatttgctgttaataatttgttctcaactctaggatgtggcttggtttttttttttctcttttcttttttaaacaagaccaagatcttgcttattcttccatg

SEQ ID NO: 2070 - DNA, 1884 bp, Homo sapiens
  ENST00000497699
cggagagacctgggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgctgacggcgcccgccgctccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggtaggtggaagccgtttctaaccagaatgcctgcctgatctatagacttgtgacagccacgactttgtatgtctgctattgattttgttgttaatgtaattagagacaccagagggagaagcctggctggatgcaaagatgcatcttgattgagtggcttttatgtctgagcattagatgtctgtctacataataggttttgcctgttttttcaacattttgaagacattaaaaggccattacatctcagtaatgacagtctgtaaacaaatgcgtttgtaagcttcttcagatagttttgcaatgttttctaaatatcgttgatttaattgtaagcttctttttaatggaattcttggttaaaatgaattgatgattatgaatatccctaggaggagttagcatggagtttgatcattttctttgtactcctttaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgcttttaaaattataaaaagcaaagagaagactttgtacacactgtcaccagggttatttgcatccaagggagctggaattga

SEQ ID NO: 2071 - DNA, 2341 bp, Homo sapiens
  ENST00000263610
acggtgctgacgggcccccggagcggcgagggcgcggagagaggacctccccggccaggtggagagtcatgagccgcgggcagccgccgccgctctccgcggtgctgatgccgccaggtgcgctcctttccgcccgctgctagcgcggcccgggcccgcagctatctgcggtgctgacctggccaccctcagccaccacttgcctggaagaagcgtgcggtttggatttttaaaacgccattctttatttagattccaacatcctcgcgtttcttctgtgccaagggggccctcgggccgtccgtctccccctttgctctccccaacttggcgcgccctccctcccattcctccctgacactcccaccaccccccctcggctcggcggctcggcgcgatgctgcagaagacgcactgagcccttttggatctaatgcgcagaggaggttggcccagagctcccgggctcccccaaggctgaactccgtccaaggtgcccgcaggctccctgcccgccttccccatgccagcccgcagctaggggcaggggcagcggcggctggggttgggggtgggtggggagcttttggggaggacaggtcgcagcttggctatggaaggctccaatggctttgggatcgactccattctctcccaccgcgcgggcagccccgcccttcccaagggggaccccttgctcggggactgccgttcgcccctggagctgagtccacgctcagagagcagcagcgactgctcttcgccagcctctccaggaagggactgtttggagacggggaccccacggcctggcggggcatccggcccaggtttggactcccacctgcagcccgggcagctctcagccccggcccagtcgcgcaccgtcacctcctcctttctgatcagggacatccttgccgactgcaaaccactcgcggcctgtgcaccctactctagcagcgggcagccggcagcccctgagcctgggggccgccttgcggccaaggccgcggaggactttagagacaagctggacaaaagtggcagcaacgcctcatcggactctgagtataaagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggactaaatggaagcgacagacggccgtcgggttggagctgctggcggaggcaggcaattactcagcgctccagcggatgttcccgtcgccttatttctacccgcagagtctggtttccaacctggaccccggcgcggcgctctacctgtaccgcggccccagcgcgccgccgcctgctctccagagacctctggtgccccgcatcctcatccacggactccagggcgccagcgagccgcccccgccgctgccccccctggccggcgtcctcccacgcgccgcgcagcctcggtgaggcgcccgtcggctccggggcctcctcccgcgggctcggcgtggccccttccgcccgcctttctgagggcgcaggttcgacgccctttcccgggagggggccctgcccggccctccctggcgccccagcccagtgccccccgaagggccaaatgccaagtccactgaggcccggaccccggactgcgtctccccagcccccctcggcgtcctctctcgcggccgctctgtccgggagccatccccacccgccgggtgtacatacgcgtctctgccactccccacccccagcctctgccggctcccctaggcaacccctttctccccaggagcgggtgcggctgattcccaggcttcgctctctcccacgccccttctacgctccaggtggagaacagcccctctccccgcgcccccgccagggagagaaggggagtgcggagccccgtctccctacccctcgagcacctgggccagcggctgagctgtacataccgtgtgcaaagtgtatatgaagttatttattcgtgacccatgagcccgtgaccgtgtccgtggattagtgagtctgtggcctgtgccctccccactcccaggcggggcaggaaggggccaagggggcttgcccacccaccccgaccccagcccccagcctcagccccggtccgggggcagccaggcctctcgggttctctcttttttaaatgtcgaaataaacttcttacaaatgaccaggcgcctgtcc

SEQ ID NO: 2072 - DNA, 1197 bp, Homo sapiens
  ENST00000542090
aggctgaactccgtccaaggagcttttggggaggacaggtcgcagcttggctatggaaggctccaatggctttgggatcgactccattctctcccaccgcgcgggcagccccgcccttcccaagggggaccccttgctcggggactgccgttcgcccctggagctgagtccacgctcagagagcagcagcgactgctcttcgccagcctctccaggaagggactgtttggagacggggaccccacggcctggcggggcatccggcccaggtttggactcccacctgcagcccgggcagctctcagccccggcccagtcgcgcaccgtcacctcctcctttctgatcagggacatccttgccgactgcaaaccactcgcggcctgtgcaccctactctagcagcgggcagccggcagcccctgagcctgggggccgccttgcggccaaggccgcggaggactttagagacaagctggacaaaagtggcagcaacgcctcatcggactctgagtataaagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggactaaatggaagcgacagacggccgtcgggttggagctgctggcggaggcaggcaattactcagcgctccagcggatgttcccgtcgccttatttctacccgcagagtctggtttccaacctggaccccggcgcggcgctctacctgtaccgcggccccagcgcgccgccgcctgctctccagagacctctggtgccccgcatcctcatccacggactccagggcgccagcgagccgcccccgccgctgccccccctggccggcgtcctcccacgcgccgcgcagcctcggtgaggcgcccgtcggctccggggcctcctcccgcgggctcggcgtggccccttccgcccgcctttctgagggcgcaggttcgacgccctttcccgggagggggccctgcccggccctccctggcgccccagcccagtgccccccgaagggccaaatgccaagtc

SEQ ID NO: 2073 - DNA, 1979 bp, Homo sapiens
  ENST00000370445
ggcggctgctgaacggcggagtggcgtggacctcatgtagcaatgacaatggaaggggccagcgggtcgagttttggaatagacacgattttgtccagtgccagttcaggcagcccaggcatgatgaatggagatttccgcccgctcggtgaggccaggaccgcggattttaggagtcaggccaccccatctccctgttcggagattgataccgtagggacggcgccttcttctcctatctcagtcaccatggagcccccggagccgcatctggtagcagacgcgacccagcatcatcaccacctccaccacagccagcagccgccgccgccggccgcggccccgacgcaaagtttgcagcctttgccccaacagcagcagccgctgccgccacagcagccgccgccgccgcccccccagcagctgggctcggccgcctcggcccccaggacttccacgtcttcttttttaattaaggacatcttgggcgacagcaaacctctggcggcatgtgcaccctacagcaccagcgtatcctctccccaccacaccccgaagcaggagagcaacgcagtgcacgagagcttcaggccaaagctcgagcaggaggacagcaagaccaaactcgacaagcgggaggattcccagagcgacatcaaatgccacgggacaaaggaggaaggagaccgggagattacgagtagccgtgagagtccccctgtgagagccaagaagcctcgaaaagcaaggacagctttttccgaccaccagctcaatcaactggagcgtagctttgagcggcagaagtacctgagcgtgcaggatcgcatggacctggctgcagcgctcaacctcactgacacccaagtcaagacctggtaccagaaccgcaggaccaagtggaagcggcagacagcggtgggcctggagttgctggccgaggcagggaactactcggcgctgcagaggatgtttccatcgccttatttctatcacccaagcctgctgggcagcatggacagcactacggcggcggcggctgccgctgccatgtacagcagcatgtaccggactcctccagcaccccatccccagctgcagcggcccctggtgccccgtgtgctcatccacggcctagggcctgggggacagccagcccttaatccattgtccagccccatcccaggcaccccacacccccggtgaaaacattgcagcgaaggcactgcaatcccttccccatatccctgcccaacccggactgctgcccgtcctctccctgctccaggccactaggcctcccttgcagccaactctggaaggcagaggagtaagagaggaagatgcttaccagtgggcaggggacccccaaagaggagccagccctctgctctccatctccccacccctagaaacagggctggaaatctcccccacagcagtgtgactggtgaaaatgctgaccccacacagagtgcaaccagtaagtgaaaacatcaacaaaaacaaaacctcaaattctttttcaaaaatgactttagggacaagcaggagggagggaggggggagggctaaggagggaagaaagaagggcacggagcggaaacagcacaggcagagtgaactatatatggacagcctcaagtgctgaggcaaagggcgttgccgaggacattccgtctgccccagagaaaagaggagggtaactgagaactttgcactgatttctcatgaccttttttcttttggaaaagtggcatgctccataatatgaaaaaaatgtacatttgaaagactgagtgataagtgatatatcatatttattatatgttgtccaaaaagagtcacttatatacgttagtaaaaacatgatttttcttttcatgtcttttcgattcagtaaaataaatgcttagacaaaaatatagatttttttgtgattgaaaattacaaaaataaagtttatctttttttaacaa

SEQ ID NO: 2074 - DNA, 401 bp, Homo sapiens
  ENST00000606445
tgtttggcatcccactgaccccacatctgtttcgctgctaatgctctgctgccagaactatccaagctgcctccctctgggcccagggactattgctgaagagatgacatctctgtatgttacccaggctggactggaactctgggctcaagccatcctcctgcctcacctcctgaagtgttgggattacaggaaagggtcccaatccagaccccaagggaggattcttggatctcatgcaagaaagaattcaggaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgc

SEQ ID NO: 2075 - DNA, 1878 bp, Homo sapiens
  ENST00000322611
gggcactgggcaggaaggggagggggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaagtctgcgttcattgcagttccagtttctcttccattctgtgtcacagacaccaacacaccactcattggaaaatggaaaaaaaaaacaaaaaaaaaacaaaaaaatgtacaatggatgcattgaaattatatgtaattgtataaatggtgcaacagtaataaagttaaacaattaaaaagaa

SEQ ID NO: 2076 - DNA, 1711 bp, Homo sapiens
  ENST00000616743
gcgcaactcgtttgcagcggcgcagcccagacgcgcctgcagctggggctcaccccaacctcgctgccagccgagaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaagtctgcgttcattgcagttccagtttctcttccattctgtgtcacagacaccaacacaccactcattggaaaatggaaaaaaaaaacaaaaaaaaaacaaaaaaatgtacaatggatgcattgaaattatatgtaattgtataaatggtgcaacagtaataaagttaaacaattaaaaagaagtaataaag

SEQ ID NO: 2077 - DNA, 395 bp, Homo sapiens
  ENST00000564123
gaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctagtctttacctggtgaaaggacacaggagatacttcaaagaaaaccagtttgttccacgaagggataagagacttgacaatctgcttcggctgaaagtgttctgcaccaggaaagaacacatcaataaattatcattaacc

SEQ ID NO: 2078 - DNA, 641 bp, Homo sapiens
  ENST00000564459
cttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggggccaagaaatgaagcttcaggcctgtgaagttggagagcagcaagaatagtgcctcagagcgaaataacttcatgcactccttcaatatctcaggaagcttactctcctcagctttctcataaaacctgaaaaacagcaatgtcaagttgttcatcaaagccacagatgtaaaatgactcacagaataaaagctgatcgttagctttgta

SEQ ID NO: 2079 - DNA, 2623 bp, Homo sapiens
  ENST00000568104
gccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcagcattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgttaaactttgtgttgattgattataaaatcaccaccaaatcagaa

SEQ ID NO: 2080 - DNA, 6073 bp, Homo sapiens
  ENST00000565781
cgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtttttattcataatcctcatacacggaaccagcatgtcagtgcatccagggtcttccagagccccctggaatctgatgtttctcttctcagcattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaagtaaattgggatgagaaaaatccttaaaaagtcacgttttccatttgattgggtcaaaatatcaggaaatttcacctgaagtatttgtaccgagatcctgtagttctaataaattcaccaaagttggggagaacttaggtttttgtttttaagagcaggtaattgatgacctaaaagtatacctggttatacttgcggttttttccttctgttcagtccggggctacctgcctggcacggctgagatgaggggcaacctcatggacaccagtgcagagcaggacctgatccgagagctgagtcagaagaagcagaatctgttgctggaactccgtaactatgaggaaaatgccaaggtaggtgtaggtcctaatgtgaccaggtaatggaggctgaaatgttgagactgaccgggaggatcagcaaatatggaagaatgagagtgtcattgccagggtgtggcctttttgccattgtcagaattgagaggggatatatgctttcgtcttgaaatttcatttccaggtagttaaactgtagaaatgttttcctgattgtttaaggacatttcctgcagcactatttatttatagcagtgaaaacagctggaagaaacttagatgttcgtcagcagtagggagtatgtgctaaggaatattaagcagctcaaagaatgaatacttggactgatatggaaggatatctgtcgtcttaccaagtgacaaaaggcaagaacaatatagaatgtcttttatctttttcaaaaacaaacatgttaaaaacagacaactgtaaaaactgtgtgtgtgcatacagcaaactggctgaaatattcctttaatttgtcctgtaatgcattactgtatttgaatttgatgtaacaagggaatttgtttgcttactttaaaagaacaatacttcaaaaatgttaaagtcatgatgggatacagtggaccatacccatagaaagatgcaagggtattttcccacagggccagatagagcaagggagcactaatgaggtgagttctctgaattctaaagaatcagattactataataataataatatgctggaggctctgtcttttgaagctgaatagcaatattatttaaaattgatattagttcagtgttttggtgactgagtaggaaatgggtggggtgttttgcaggctgaattggccagtccactgaacgaggctgatgggcatcggggcataatcccagccaataccaggctccacaccacgctctcagtcagcctggggaatgagacccaaactgctcatacagaattacgcatttccacttctaatggtaagacagtactcacagctggtatttagaggcacctgtgccatcttggagtcattcttttttttttttttgagacagagtcttcctctgtcttggctcactgcaagctctgcctcccgggttcatgccattctcctgtctcagcctcccaagtagctgggactacaggcgcccaccaccacgcccagctaattttttgtatttttagtagagatagggtttcaccgtgttagccaagatggtctcgacctcctgacctcgtgatctgcccacctcagcttcccaaagttggagttgttcttaaactgtttttactcttccctgcagacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcaggtgaccctttgcaagtcacagttcatttcaggacagcacttagaggagggcaagatgtataaattttccatatgcccagtggattcttgggggcctgagaaaccatttaatggttctgtctacccaaagtttctcatgaccttttatttcctcagtttgaaacctgtaaaaagaaaatggaaaaactgatatgtaagtttaagatggttctttttttttttttttttttgagacagattctagctttgtcacccaggctggagtacagtggggcaatctcagttcactgcaacctctacctcctgggttcaagcaattcttctgcctcagcctcctgagtactgggaccacaggtgcccaccaccacgcccagctaatttttgtatttttagtagagacaggagttcaccatgttggccaggctggtcttgaactcctgacctcaggtgatccacccgccttggcttccgaaagtgctgggattacaggcatgagccaccacgcctggctaagatcattattttctgtttttagtcaggtgatctcataatcaaaaaatgtttaattgatgatttgtcaatttgtagttttggccactaaaactacaagagttaggatgcacctttatattacagtcatacataacctcagctagtgaagaaaaactgctctatttgtggaagataagatactttttacatcccctttatgatattttaaacccttagtgcatgcaggtatatatgtagactcatgctgtctttaaatcccaaacctaatatattactgtagtactttaaccctcaagtgttttgggggttccttcttaagtgaaacccttaaatatcaattgatgacccagaagtggctttattttctgggccttgcattttgaaagaacattctatacaaaacaattctcttgtgtttcattgattggccatagcacccagtttcatgtatttgaatcgacaagacagctccctcgattctccatgtatgcgctgaccagcctggaccctgccagtgagccaatcagttatgttaactttaccattgcagaacgggcacagagggtgagtatctcgcttttctctttcaatgcttttacacagtagaatcctttagatgttatttcatagaaagggaaaattacattaatgtgttatattggtagcagtaaatatgatatgaaagaattctctaacttgggggtggcttgtaacctgtaataaaaatattgctaaaataccttctctcactttgaaaaagcatctgagcaatcctcagttattggtgaattcttaccagtgtttaattcctctctttccgttatggtcttagtgtggttgtcctggtgtagtatttcaagaggaacctgcagcaagatgaaaagagagtgggacttggagctaagaacgtttttggctttaagtgctacgttaactcattaaattcttagtgatcttggggaagtcccctcaccagtgtgagcctcagttttcttatctaataagtaaggataatcttacccaccttattgcgggggcccgaggattacatgattggtgtaacagtagcaccttgtacatttgaaaggactaataccagtggactttaaccttggctgggctttggaattcttggtgggactttttaatcatgtagattctcaggcccctgcctggcctgtggaaccacagactctataggtgggcccttccagaaggcctcatgggtggttctcatgtggaacctgtgttgcaagccactgcatggtgttactgctattaacattaaaacttatattttccttattgtgtggatatatctgtggtgtttgcccatgtatacttcattttacatttcttaaagaatagaatggaatggttttaagcacgctacattgtccaggttatacccacagaagagctgttgtgtaacagaatcagcatcatacctgaatcatttgtacattgcatataagactatgtctaagtagaagatgctatgaaatcatgtctgctgtggggccaggcataattatgaatgttacttaagagcataggtgaggtgagaaaagggaatgtgactagtgttttagtattttcttggtgtgggatgaagtataattcttttttttttttctcaacaaagcagtaaaactagaaagaaggagaactcttccctcaagaatggctgtaccttcatatctagaggcacattaaaaaaaagaacgtctgtaccttaaaaatggaggtcatttcattgtgttcattttcaaggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgttaaa

SEQ ID NO: 2081 - DNA, 2963 bp, Homo sapiens
  ENST00000245157
tgtcaagtttgcagggtgcagcttggatgtggtgctagaaggggaagcctctgggctgagcatgtaggctcgtcagtagagttcaacccgcaggagtaaattactgcagtgggaaacaaccgcacccgcggcccagcaggggttccactgcgcagccgcaaaaggcgccgaggctccactgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcagcattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgttaaa

SEQ ID NO: 2082 - DNA, 4026 bp, Homo sapiens
  ENST00000562813
tattgtgcctcccaaagatgtccctgtggatctgcacttgaaggcattcgtgggttacagaagcaggtgaccctttgcaagtcacagttcatttcaggacagcacttagaggagggcaagatgtataaattttccatatgcccagtggattcttgggggcctgagaaaccatttaatggttctgtctacccaaagtttctcatgaccttttatttcctcagtttgaaacctgtaaaaagaaaatggaaaaactgatatgtaagtttaagatggttctttttttttttttttttttgagacagattctagctttgtcacccaggctggagtacagtggggcaatctcagttcactgcaacctctacctcctgggttcaagcaattcttctgcctcagcctcctgagtactgggaccacaggtgcccaccaccacgcccagctaatttttgtatttttagtagagacaggagttcaccatgttggccaggctggtcttgaactcctgacctcaggtgatccacccgccttggcttccgaaagtgctgggattacaggcatgagccaccacgcctggctaagatcattattttctgtttttagtcaggtgatctcataatcaaaaaatgtttaattgatgatttgtcaatttgtagttttggccactaaaactacaagagttaggatgcacctttatattacagtcatacataacctcagctagtgaagaaaaactgctctatttgtggaagataagatactttttacatcccctttatgatattttaaacccttagtgcatgcaggtatatatgtagactcatgctgtctttaaatcccaaacctaatatattactgtagtactttaaccctcaagtgttttgggggttccttcttaagtgaaacccttaaatatcaattgatgacccagaagtggctttattttctgggccttgcattttgaaagaacattctatacaaaacaattctcttgtgtttcattgattggccatagcacccagtttcatgtatttgaatcgacaagacagctccctcgattctccatgtatgcgctgaccagcctggaccctgccagtgagccaatcagttatgttaactttaccattgcagaacgggcacagagggtgagtatctcgcttttctctttcaatgcttttacacagtagaatcctttagatgttatttcatagaaagggaaaattacattaatgtgttatattggtagcagtaaatatgatatgaaagaattctctaacttgggggtggcttgtaacctgtaataaaaatattgctaaaataccttctctcactttgaaaaagcatctgagcaatcctcagttattggtgaattcttaccagtgtttaattcctctctttccgttatggtcttagtgtggttgtcctggtgtagtatttcaagaggaacctgcagcaagatgaaaagagagtgggacttggagctaagaacgtttttggctttaagtgctacgttaactcattaaattcttagtgatcttggggaagtcccctcaccagtgtgagcctcagttttcttatctaataagtaaggataatcttacccaccttattgcgggggcccgaggattacatgattggtgtaacagtagcaccttgtacatttgaaaggactaataccagtggactttaaccttggctgggctttggaattcttggtgggactttttaatcatgtagattctcaggcccctgcctggcctgtggaaccacagactctataggtgggcccttccagaaggcctcatgggtggttctcatgtggaacctgtgttgcaagccactgcatggtgttactgctattaacattaaaacttatattttccttattgtgtggatatatctgtggtgtttgcccatgtatacttcattttacatttcttaaagaatagaatggaatggttttaagcacgctacattgtccaggttatacccacagaagagctgttgtgtaacagaatcagcatcatacctgaatcatttgtacattgcatataagactatgtctaagtagaagatgctatgaaatcatgtctgctgtggggccaggcataattatgaatgttacttaagagcataggtgaggtgagaaaagggaatgtgactagtgttttagtattttcttggtgtgggatgaagtataattcttttttttttttctcaacaaagcagtaaaactagaaagaaggagaactcttccctcaagaatggctgtaccttcatatctagaggcacattaaaaaaaagaacgtctgtaccttaaaaatggaggtcatttcattgtgttcattttcaaggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtgagggaatgcggtagatgcatttgtgagaatgtggtagtctaataatatttgaggagattaatggtactacaaatgtacttatgttatagtgatgttttcaagaatttttgcaattcttgaagtaaaaattgaactagtattggagagtttactacttaaggatttattttataaaaggaagtgtttagctcctgagcaccatgcttgctttgtttggtttaaagtgatgcatttaaatattaacattttcctttgttagctcttcatcttatttgtagtatctgctttggtcttcttcagtttgggtctttccaaaaacccaaattcaagataaaagagcaaaataaagatgattctgattggccccaaagtatacaatattcccactgcaaatccctaaaatattaatatgtgtgttgtgggggctcctggtgctaaagcatggggaagattcacatggagtgtcgtgttgaaattggaggcagcacagatgagttaacttgttgagacagagatgaaataacgggaagtagcttaattggtataagcgaacaggggaaagaagggggtctctgtatctggtaaatagtgtcttttcatttgtctgggttcaagaagtttgtgaggcctttttcattcctgagtgttcatggtctccaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgtt

SEQ ID NO: 2083 - DNA, 716 bp, Homo sapiens
  ENST00000569192
ttctgggccttgcattttgaaagaacattctatacaaaacaattctcttgtgtttcattgattggccatagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaag

SEQ ID NO: 2084 - DNA, 766 bp, Homo sapiens
  ENST00000566495
ggctctgtcttttgaagctgaatagcaatattatttaaaattgatattagttcagtgttttggtgactgagtaggaaatgggtggggtgttttgcaggctgaattggccagtccactgaacgaggctgatgggcatcggggcataatcccagccaataccaggctccacaccacgctctcagtcagcctggggaatgagacccaaactgctcatacagaattacgcatttccacttctaatggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaag

SEQ ID NO: 2085 - DNA, 588 bp, Homo sapiens
  ENST00000561877
caacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagaggcagtaaaactagaaagaaggagaactcttccctcaagaatggctgtaccttcatatctagaggcacattaaaaaaaagaacgtctgtaccttaaaaatggaggtcatttcattgtgttcattttcaaggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtc

SEQ ID NO: 2086 - DNA, 350 bp, Homo sapiens
  ENST00000566410
cattgattggccatagcacccagtttcatgtatttgaatcgacaagacagctccctcgattctccatgtatgcgctgaccagcctggaccctgccagtgagccaatcagttatgttaactttaccattgcagaacgggcacagaggtaaaactagaaagaaggagaactcttccctcaagaatggctgtaccttcatatctagaggcacattaaaaaaaagaacgtctgtaccttaaaaatggaggtcatttcattgtgttcattttcaaggttgttgtatggctcggtcagaactttctgttaccagaagacactcacattcagaatgctccatttcaagtgtgtttca

SEQ ID NO: 2087 - DNA, 299 bp, Homo sapiens
  ENST00000566452
aacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggtgagtatctcgcttttctctttcaatgcttttacacagtagaatcctttagatgttatttcatagaaagggaaaat

SEQ ID NO: 2088 - DNA, 445 bp, Homo sapiens
  ENST00000566210
caccacgcccagctaattttttgtatttttagtagagatagggtttcaccgtgttagccaagatggtctcgacctcctgacctcgtgatctgcccacctcagcttcccaaagttggagttgttcttaaactgtttttactcttccctgcagacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacggg

SEQ ID NO: 2089 - DNA, 865 bp, Homo sapiens
  ENST00000562012
gatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccct

SEQ ID NO: 2090 - DNA, 598 bp, Homo sapiens
  ENST00000562059
ttgaatttgatgtaacaagggaatttgtttgcttactttaaaagaacaatacttcaaaaatgttaaagtcatgatgggatacagtggaccatacccatagaaagatgcaagggtattttcccacagggccagatagagcaagggagcactaatgaggtgagttctctgaattctaaagaatcagattactataataataataatatgctggaggctctgtcttttgaagctgaatagcaatattatttaaaattgatattagttcagtgttttggtgactgagtaggaaatgggtggggtgttttgcaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcact

SEQ ID NO: 2091 - DNA, 1525 bp, Homo sapiens
  ENST00000569342
gctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcagcattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaagtaaattgggatgagaaaaatccttaaaaagtcacgttttccatttgattgggtcaaaatatcaggaaatttcacctgaagtatttgtaccgagatcctgtagttctaataaattcaccaaagttggggagaacttaggtttttgtttttaagagcaggtaattgatgacctaaaagtatacctggttatacttgcggttttttccttctgttcagtccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggg

SEQ ID NO: 2092 - DNA, 845 bp, Homo sapiens
  ENST00000561951
gatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaagaacaatacttcaaaaatgttaaagtcatgatgggatacagtggaccatacccatagaaagatgcaagggtattttcccacagggccagatagagcaagggagcactaatgaggtga

SEQ ID NO: 2093 - DNA, 473 bp, Homo sapiens
  ENST00000561853
cagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacatccggggctacctgcctggcacggctgagatgaggggcaacctcatggacaccagtgcagagcaggacctgatccgagagctgagtcagaagaagcagaatctgttgctggaactccgtaactatgaggaaaatgccaaggtaggtgtaggtcctaatgtgaccaggtaatggaggctgaaatgttgagactgaccgggaggatcagcaaatatggaagaatgagagtgtcattg

SEQ ID NO: 2094 - DNA, 775 bp, Homo sapiens
  ENST00000565859
cagaaacagaggtaagaagctccacctcgaactatggtaaccttgagcaagatagatcagtactgtcagatgaaacatcaagtgagagtgctggggcatctccaaacccaggtggttttaggataaaagcttggggagggggtcagacagagctgtatgttatggtaagaaaagcaataaaaatcctaattaagatatattttgaaaagactgattaaatagagaaaaattattgcatatagttgaatacataaaggcatttcttttaatgagttaatacatgcaaataataataatggcaatcatttattatgtacctattgtatgccaggtagtgctctaagtactttatatgaagtaacatattgaatccttacaacaaccctaataggaagataaattattattatttctatagatgaggaaaatggtgttctggttttttgtttgtttgtttgtttgttttgaggcagagttttactccatcacccaggctggagtgcggtggtgcgatctcggcttactgcaagctccacctcccaagttcaagtgattcgcatgcctcagcctcctgagtagctgggactacaggcacgcaccaccacgcctggatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatga

SEQ ID NO: 2095 - DNA, 564 bp, Homo sapiens
  ENST00000569941
actgggggaaagtctgactcctgagatccttgttgctcttgacaaaaattgcaaactctttccattccggtttttattcataatcctcatacacggaaccagcatgtcagtgcatccagggtcttccagagccccctggaatctgatgtttctcttctcagcattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagag

SEQ ID NO: 2096 - DNA, 578 bp, Homo sapiens
  ENST00000566689
ggcgagcaccttgtggctccatcctgcagaggacagtggggtcttagaggaagagcttttctgagaagttgacgttttcttgtcatcaggcacttggagtcaggcgaggtttttattcataatcctcatacacggaaccagcatgtcagtgcatccagggtcttccagagccccctggaatctgatgtttctcttctcagcattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagat

SEQ ID NO: 2097 - DNA, 574 bp, Homo sapiens
  ENST00000565378
agcggacgggtctgcgccgccgcaggaggagcaggcggtacctggacgggttcgtcccgggctgtttcgcgtccggcctgaggcggctggggccgcgcaggtttttattcataatcctcatacacggaaccagcatgtcagtgcatccagggtcttccagagccccctggaatctgatgtttctcttctcagcattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggtatgaagaagaaaacattctttttggttactggagacaatgttaattccttggccttgtgtgactttgatggtgatggaaagaaagagcttcttgttggatctgaggattttgatatcc

SEQ ID NO: 2098 - DNA, 4064 bp, Homo sapiens
  ENST00000393422
tttgcctgccaggagtgggtgagggaggagcagccgccgccttcacagacacctggtagtgtcaggagagggcatgcactgccctggtgaggctcctctggctgcccccaggcccacacccaaggatccctgcctcagaaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagcagctgcctgagggtggcagatgagagcagcccggggtgggtgacggttctggggaaggcacccgggggcaagggccatgcgtggcatctcccgggagggcagaggaggagtgggtctctctagaagaaaaccaaggaacgccgaggctgggtgtctcctggaggcggggtgaggcctgcagctggccacaaggccctgggagccagggcagagcctgggcccaagaaagggggcagtttcagagctgcagggtctggggcccagaaagcacagcctgggcatggcccctgcaaccctagggagctgccacagtgagcacctgcccatgcccacagctggcatctggagtgagggcagattggggcaggaacagctgcacaaggggacgggttcctgtgagccgagggcaccgctgggggctgcatccagagctctgcttaaaagaatctcatcccagcctgcggaactcccgaagtgcacatggaattatacctggacctggcatctgagttgggagggaggggcttggagaagacccttgccctgggcaagtgtgtcccccttcgtggctcccccacccagcagcccgcagcccagatggaagcttcagggtgcttggaacccctggtgctgctcccagccctgaccgttctgcatatgaacatgggccttggtttccccatctgtatgaagaagggagtagggctgggtgattcgcaagccctcctgatcttacctctacagaggttgtccccgtgacagcatctgtccccccacctcagccacatcatgctcagcccacctgccttggtgaggacacagaggtaaaggtgtatgcagttgc

SEQ ID NO: 2099 - DNA, 3221 bp, Homo sapiens
  ENST00000162330
ggccgaggcggcagctgcgcggcggcaccggggcggctgcggcgcgctcggagccccgagggcacgcggcccgggcagctcggtgtgcgcccccgcgagagccggggccccaggcccgccggacaccatgaaccacctgaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagca

SEQ ID NO: 2100 - DNA, 4659 bp, Homo sapiens
  ENST00000562556
actttcctgggaagttttcctctcgctgcggaacccccggggccctgactggccgcttcctccccgctggccgtagggagttttctgtccgacaccccctcttcctggccgggcagcctggcttcggcagacccccgggccatgtttccacacttgggcactggcatctctgagcatctcagtctcacctcctgagaacagcaagtgatcctggctaccccgggtaaccaggcctcaggtgcaggccccacatgacagatggacagactgaagtgggaggtgggaggcggacaccccggcgtcctgccaggaagggacaccatctgcacctggcgagctgtggcctccagccatcgtttccctgcctagttaggggcttttccctccagagccctgtccactctggccttgtttctggaactgctcctcacccggaggaccccatcctttccgtgaagcaggcagtgggggctttctggcaagtggcctcttcattaactatcccagagtgagtgcagatgaccagagggaagctggccaagtgcaaagcattgttattgtggaattaaagagcccgctcctgctcgcctccagaagtggtaatgtatttacagatgaaaaaatgagggcttccagactgtgctgatgtgagccccgccatccgttctggttcagagcataatcgtctcgtcttcagaaagaaggaagacagaacatgcctgccaagcccttcctctcttctgttctgctctcctggaaagttctggacttctctggcccagggcctcaggggactggccagccctgctcctgtgggcactgggcagagggacaaggcggaccacctgagcctgctggagggccggtatcccagggcagtagtgattagggaatgtcactctggccacatcccagcctgggcgggcctctatggggaggtccccgtttgatttggtttggttgtccacagtcagagccaagctctgggcatggagtctgggatggcaccctgaccccttgccttacaggactttgggcagccttctttggcactgtgcctcatctgtaacaagagaggaacagcgggctgggtaggacttggacagataggcactgtcgtggggacctgcagcctggccacaccatcacgggctctgagtcatctcctaccctctcccttgtagtcacagcccaggagaattctgctgggggtgggcagaggtctttgccatctgccccctacgtggctggctggcagatcaccgtggctctctctcctgggaccttgggcagtgtgtgaggtggtggggccaagaggagaattcatttttggaacagtcttgaagtgttcggaaaattgctttcatgtgctgaggaggccctgcggaggcttccagactgagctgcctgctcaagccctgcccttggaacccagagtggcgactgctcagggacacgtctgggttttaagcacacccatccatttgggcagtcttttcctagatgggctgacgcagcaggcactttggcccacagaaattataagatgcttcagaaggggatgggaggggaagcaggaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagc

SEQ ID NO: 2101 - DNA, 2692 bp, Homo sapiens
  ENST00000563038
cacagagctcagtcgcacacctgctgcagagtagaaagttcacacgtggtggtggtgctgggtggtaacagtgatggtggtgatgaggtggcagcggcggtgatggtgatgaaatcatgatatgatggtggtggcagtggcagtatcacagctaacctttcagtgagtgtctgcagtgacacaattatgtgaattaacacatgcaattctttgggaggaagctctcccaccttcaggcacaggggtggtcacctggctccagagccggctcgtcccagagctgtcatggataggaattgtgaaggatgtgtgtgctagggctgcgagtgtgtgtgcgcgtgtgtgtgcctgtgtgcgtgcctctgcatttgtatgtgtgcctgtgtgtgtgcgcgtgcctctgtgtgtgtgtctgtatgtgtgtacgtgtgtgtgtgtgtgtggctgggtgctgcccccagtccctggggtgggcagatggacagatggacagtcttgaccaccgcttgtcccccaggtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaagg

SEQ ID NO: 2102 - DNA, 3024 bp, Homo sapiens
  ENST00000566982
agccgggactctgctaccaggcgtgctggagacctagtgggcccagttctgctgcgctgcggggggctctgccaggcctgcggctgctggggggtgctggcgcctctgccacccccatgctcagcgcccccctcacagcaccctcagcaagcagggctggctgcctgcctgcattgggagggcctctaggggttcaggggcactgggcccgggggaggggctgctttggcgctgctgccctgggggatgtgcggggaggccctgagtcaaccctgtcccagacatcccctttgatgaaggaacaaaaggtctttcagtggagagagctgaacagggagcctggtggtggaggcgtgtgggcgcagtgtgcccgggggctggagaatcccaccagggaggccttgacctccccaaggcagggagaccttcagggaaggaggctgcctggcatggcccctacccgcttcaggctggtgctggtgaggggtcctgtggccctgggcaggccattgtgctgcctgcctcttcacccactgtgcgggccttggcttccctgggctctgggtcatggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaagg

SEQ ID NO: 2103 - DNA, 2894 bp, Homo sapiens
  ENST00000535626
aggagccggaaagcgccgggacccctcgcggggcctctgagcggcgcgggcggacccgagcccccagcccgctggcgccgctgcccgccaggccccgggggcggcggccaagatgtccgtgccttgccgctctcctaccccatgtcgctgaagcagatgagttggagcaggactcaggagggtactaggcccaggttttaggctgaacctaggaatgagtaatgagaggaggcagatcagctggaggaccagcccgagtccccagatgtcggcacaatgcaggggaagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtct

SEQ ID NO: 2104 - DNA, 3192 bp, Homo sapiens
  ENST00000538440
atgcgcggcgcggctggagcggccggacagtccggcgtccgggaacgctcaggagccggaggagccggaaagcgccgggacccctcgcggggcctctgagcggcgcgggcggacccgagcccccagcccgctggcgccgctgcccgccaggccccgggggcggcggccaagatgtccgtgcctaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaact

SEQ ID NO: 2105 - DNA, 3387 bp, Homo sapiens
  ENST00000418647
atgcgcggcgcggctggagcggccggacagtccggcgtccgggaacgctcaggagccggaggagccggaaagcgccgggacccctcgcggggcctctgagcggcgcgggcggacccgagcccccagcccgctggcgccgctgcccgccaggccccgggggcggcggccaagatgtccgtgcctatgaaaaaatgagggcttccagactgtgctgatgtgagccccgccatccgttctggttcagagcataatcgtctcgtcttcagaaagaaggaagacagaacatgcctgccaagcccttcctctcttctgttctgctctcctggaaagttctggacttctctggcccagggcctcaggggactggccagccctgctcctgtgggcactgggcagagggacaaggcggaccacctgagcctgctggagggccgaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgaca

SEQ ID NO: 2106 - DNA, 2846 bp, Homo sapiens
  ENST00000542031
aaaggcctgtgacatttcctctggtggtttccacgaacccaggcgtcacccctcggtggagataaagtggagccacccagctccaccgtgtctcagcctggggtcggcctctgctgcttctggactcagtgaccctgggctgtcagggagcttctgagccttggttttcctgtctagtaagatggagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggct

SEQ ID NO: 2107 - DNA, 2725 bp, Homo sapiens
  ENST00000420641
agatgctcacccaccgtccccaggaagcagaacagaggggtcggacccctggtccttcctttgagtggaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctgg

SEQ ID NO: 2108 - DNA, 2667 bp, Homo sapiens
  ENST00000393420
atgaaccacctgaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtgagcaaatgccagggcaatgccagggccaggctgaggctgtggggtgtctgggtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctga

SEQ ID NO: 2109 - DNA, 714 bp, Homo sapiens
  ENST00000569340
gccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatg

SEQ ID NO: 2110 - DNA, 552 bp, Homo sapiens
  ENST00000564170
cctaaaaggacgtggctcccaggtgtgagtggagcctccctaagggctggtttgagggcagcagtgaagtcggctctctgcccccaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtgagcaaatgccagggcaatgccagggccaggctgaggctgtggggtgtctgggtgtgtgcacaggggtgctgaccagtgtctgcagggctgggggtggcgggcaggaagagactggctccagaccctggttctggatggttgacagatgaggaaatcaagctgtcttctgagcctcaggttctt

SEQ ID NO: 2111 - DNA, 556 bp, Homo sapiens
  ENST00000568864
cagccctgctcctgtgggcactgggcagagggacaaggcggaccacctgagcctgctggagggccggtatcccaggaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctg

SEQ ID NO: 2112 - DNA, 558 bp, Homo sapiens
  ENST00000564028
gtgcatttgttggagagcggtgtcctgcgccctaggctggaagcctggcctcgggcaggggcctggagcctcggggttggagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacaga

SEQ ID NO: 2113 - DNA, 547 bp, Homo sapiens
  ENST00000566465
ataaaggcatctgctgtggtgctgcagccaaggccaggctgtgctctgtgcttgtgtcggggagcccttggcagtggccaccccacagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgttt

SEQ ID NO: 2114 - DNA, 574 bp, Homo sapiens
  ENST00000569006
agtcctgagtgcatgctctgcggtctggggtcacctggggtgcttaccagtaggcacacgcctgggttatgaggtggaaggtgcgagctctgctggccatgggagctgcgtggggcattgcccctctctctgcctccagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcg

SEQ ID NO: 2115 - DNA, 594 bp, Homo sapiens
  ENST00000561970
aatgattcactccggccgccggcgcggggttccgggagcggagcgggagtgggggcgggcgcgccgcgggctttgcagccccgcacgccgagcgccggtggaagccgggtcctggccacaggagtcctagccgcacgcgagtgtcgcgggagggggccagggccgggttctgcagtgtggacatgaaggctttggagtccatggttgggggacccgcaagagctagagcagggtcggagctccctctcgagggtccgagaggctgatcgctggaccgagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccc

SEQ ID NO: 2116 - DNA, 558 bp, Homo sapiens
  ENST00000563323
tccggggtggggagctcctcttccctgggggtctcggggctcgctctcagctgggggagggcagaggggctccgggaggcctgctatgctgccccgcgatcaccttccgccggccgagccctcccggtctgcgcccggacacagggcctaggagcccggccagggccacagggcagtgtagtgttgggggaggggactggttgggcgacccagagctggtgcgactggaggtggcccgcgagggatcggcgaggagcggaggagaccgcgcctccccgccgcgttgggccgacagaaaaaggcctagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctgg

SEQ ID NO: 2117 - DNA, 581 bp, Homo sapiens
  ENST00000567215
gcagatggggacactgaggtacagagagacagtcagttgtcctcagaattggatccagaacctcgtcttctggcatggccccccagtgcagcaccacatgtggcctccgaattcccagtctgggattgggggagctctggtccttgggggaccaccatgctcttttggagttgtcaacttggtaggaaccctctggttccaacgctgtgcctttgcggccctctcctggcatctgctgtccctttaggaggtcctaccacccttttcttctgagcctggacaactccttcccttgcccccaggagcccacagccggctaaaccaactggtcagctagaaccaaccagcaggggagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccg

SEQ ID NO: 2118 - DNA, 576 bp, Homo sapiens
  ENST00000563700
gtgagcactgtgtactggtaccatggccccaggtctaggcgagggatggaaataaggacagtgccactagggcctcctgtctgtacaggaggggccctgagacagctcctcaaacccctttcccattatacggatggtgcagatggggacactgaggtacagagagacagtcagttgtcctcagaattggatccagaacctcgtcttctggcatggccccccagtgcagcaccacatgtggcctccgaattcccagtctgggattgggggagctctggtccttgggggaccaccatgctcttttggagttgtcaacttggtaggaaccctctggttccaacgctgtgcctttgcggccctctcctggcatctgctgtccctttaggaggtcctaccacccttttcttctgagcctggacaactccttcccttgcccccaggagcccacagccggctaaaccaactggtcagctagaaccaaccagcaggggaggtgcgctccaggggggcttctaagaggaggcagttttggagtcagagaacgtgctggccaaagcgctctatgacaatgtggcc

SEQ ID NO: 2119 - DNA, 1340 bp, Homo sapiens
  ENST00000546196
actttcctgggaagttttcctctcgctgcggaacccccggggccctgactggccgcttcctccccgctggccgtagggagttttctgtccgacaccccctcttcctggccgggcagcctggcttcggcagacccccgggccatgtttccacacttgggcactggcatctctgagcatctcagtctcacctcctgagaacagcaagtgatcctggctaccccgggtaaccaggcctcaggtgcaggccccacatgacagatggacagactgaagtgggaggtgggaggcggacaccccggcgtcctgccaggaagggacaccatctgcacctggcgagctgtggcctccagccatcgtttccctgcctagttaggggcttttccctccagagccctgtccactctggccttgtttctggaactgctcctcacccggaggaccccatcctttccgtgaagcaggcagtgggggctttctggcaagtggcctcttcattaactatcccagagtgagtgcagatgaccagagggaagctggccaagtgcaaagcattgttattgtggaattaaagagcccgctcctgctcgcctccagaagtggtaatgtatttacagatgaaaaaatgagggcttccagactgtgctgatgtgagccccgccatccgttctggttcagagcataatcgtctcgtcttcagaaagaaggaagacagaacatgcctgccaagcccttcctctcttctgttctgctctcctggaaagttctggacttctctggcccagggcctcaggggactggccagccctgctcctgtgggcactgggcagagggacaaggcggaccacctgagcctgctggagggccggtatcccagggcagtagtgattagggaatgtcactctggccacatcccagcctgggcgggcctctatggggaggtccccgtttgatttggtttggttgtccacagtcagagccaagctctgggcatggagtctgggatggcaccctgaccccttgccttacaggactttgggcagccttctttggcactgtgcctcatctgtaacaagagaggaacagcgggctgggtaggacttggacagataggcactgtcgtggggacctgcagcctggccacaccatcacgggctctgagtcatctcctaccctctcccttgtagtcacagcccaggagaattctgctgggggtgggcagaggtctttgccatctgccccctacgtggctggctggcagatcaccgtggctctctctcctgggaccttgggcagtgtgtgaggtggtggggccaagaggagaattcatttttggaacagtc

SEQ ID NO: 2120 - DNA, 6112 bp, Homo sapiens
  ENST00000448484
acacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacggcatcgaaagcagaaagtgtctgtgatggacaagctggtcagaagacatccgagatccaggctagaggcaccaagaaaaagcacctggatagccccaggctaggactcgcctttagaaaattctttaggcataagggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaaggtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtacacagggaagtgtgtcttctcccatgtcaagaagaagtggcctttccaggaatggagctattgagctgaaatggctgccactgcgcgtacacacacacacgcgcacacacacacacacacacacacctcccttccagttccagctgacggtgactttttgactggtaaccataaaagaattcattcaaaagggcagttgttcccagcagccagtgaggtccttcctgcattcgttgtcttggagaaggaggcacataacaaaatagaaaccaaaatgggaaggaaaagagaaagaaagtgaaattcctggtctttgttgtatgtatccccttgctttttagataaattatcaggggtttaaacacacactctctcccctccctcctcccacttcacacacactagattgttcttgtctgtttgcaaacagtccagaagcactggggtctcattaaattagattctaagtgtcttaaagaattagatttcaagaaaccaagaatctgtgtcctttcccttctcagagtgcctggaagggtgcagatttctccaatctgaatctgacaatgttatttcttatgtcagataatcccaagtagatcttataccttaaaaaaataaaatcagctacactacctaccttacagggaaggaaaaagaactaattccaattattaactaacccaagatacaaacacaggggaaactagggaatgtgctttgcagcaatgtaagattataggggttggttttaaccatcctttgaatgtccctctttaagcctttttaaagggcaattttgcacggtgagtagaattaggcttctccgtggtcaagattttgttcactctatcagtgcaaattaagtggcaccggcccactggaaattatagtctccattaggaagaaaagaaattacttaccgagcagcaaattctctaaatttgtaattcagatctttagtgcagaatgccggtcaggatccagccctttgcataaattggttttctggggagtttaaccccttagcctctgttgcccttttcttgaatggcattcacgcaaccctctccatctcctggccctttaactggccccggcagaagttgcagtccacaatttcacagaagtaaggataatacattatcacacattaccgtttataaagtgctctgggtacaatctgtaatttaaagctgtatttccctcactgaacttaagtgcttcctttgttacatttcattaccgggggactggcatgcacctgtatagattttttttttttttttcattttttgttttgttttgtttttccaaataagcacttcttgacaaaatggcccccagctgcacttctgctaatgacagccatggaagggctggttccttacgtgatctactctctcagaagcttgcttttgtcaaaatgcagccacgtgggggagctgcaggacctggggttttacaatgcctagccctttttccctgattgcctaaccgggaaactgggccaaagcagcctgagagtgtatttgttgattaacttctagaaagcagtcaagtttaattaggagaactagaacgagaaagctgaactgggcaagtcagttgccttctatgattctcagtcctccaaatgaagataaggttggttggtttgtgtttccatccttatctgctctatcttggaagaagctcaaggaagattgtgtgattgcaaaacgtttcagttggtgtcattgcaatgcatttaagtaatccttactggcccatcctgctccacaaagcagccttacctctcatcttctccactcccaactaaagagcaagtgatttaaactctgagtgtcctccctcaacaatgggctaataatagagcctactcgtggagttgctgccagcatgcagtgagatggtgcataccaaacatttagtgcagtggctggcacattgtaagcacttaggaaaggcaagctattctatcatggggaacttttagcaccaagtaacagaaaacccctacttgaattggcagataatcgtaacaataagggtatttatcatttcatataataggtgttgtataacatctttggctttgattctctgagactctcttccagctaacaacgataatgaggaaatgtatcgtttcatataactggtgttaagtctcatagcctggctctggttctctgacactccattctgccatgttccatgggttgacttcatcctaaaactgtgctgaatgatggatgcagttccaggcaaggggattatgggaataccataatcagtttcaatgaatcattttggtgaaatcatgttgagaaggcaatacaatgatacagtagacagtaaagccattattggtatcagtggctttaaggctaaccattccccaaactaactgtgtcccttcaattcacacccatgggatttgtgtaatgacggcccccaccttccaaagcagtgccactagaatgtgaacttatcaagatctgaaccttcttgtcttgctcattcattgttctattgtcagtgtctagcacaatgcctggacatggtagatactcaacaaatattggttgaatggataaattgctaaacaaatatcctgtggccacacccattgtggattgccttatcctctagtgtgaatttgttttagctctgaatgtctgatcaccctaaccagacatctacccttcccaggtaaccagcccagtggttctaaaagtacagtcccaggaccagcagcctcagcaccacctgagaacatgttaggaatgcaaactctcaagccccactccatacccgcagaatcaaaaactcttggggtgggacccagtaacctgtgttttagcagcctctcaggaggttccaatgaaggagaaaatttgaaaaccactggtccaggtagagctaccacttcactgagcatcaacagcatgtttggtccaaagactggccctgaagatgcttagataaaaaaagctaacattgaacctcactatatgccaggtattgtgtgtcacatgacttaactttgttcactgcttatttggcagctgaggaaactaaggctcacagagaaaaaaacaactttgcccaagaacacacatggcagagccaaggttgaaatccaacctaagtacataaaagcttgctttcatgtctgtgggagagacaggcaggcaaaaagataataataatacaatgtaagagaagcaaatgcagggtgtcatgggactcaggggaaggcactggcgcaagaccacagtgggtggaggttggccactttggggaggtgacagttgagttaactcacacagaatgaataagcgttggacaaaagggctcccagaagaacagcaagtgcaagagcccagggtccacagagagaatggcaggtagcttagcatggctgaagtgagactgtgaggagaacggataagaggatggaagctggggaggtggcacagatggatctcaaggacttggagtaaaaagtccatagtaacgagtttaaattgtctcttgacggcaatggggagccatggaagatatttgagctggagggtaacatagatttatattttggctgcaggtaggatctaatacaaaagcaattcaactaatattcactaagtgacctgagttatctgtgagatatttattataaggtgttaaacttctttgaagattgtaagaaagagataaaacctctaaatggttttgacccttcaaaggacatttaaatggttatttctaagtgtcataaacatggacttgggatttggcctcatcattcacccagatgattcatacccatgatcccaggctgtgaggtcttgagcaaattacttcttctcagagccttagtttgttcctctgtggaatgggaatgctaacagcacttacctcggaaagttgctgagaataaacgagaccgtgcatttagagcatgtaggcaccgtgtctggcaggtaatgagtgctcagtcagcttattgatgaggatgcagatgacctcagcctgagatagaacagatgtgttctctttcatggactgaaggccacccagactttgcgacatccttaaactttgccccagtttctccttatcctcataagcagttggctggctggcttatctagaaaaaagaaaggagggaggagaaaaagcaaagaaaaatgttcattttccctgctgttcaccccattctaaagtaaggcagaatttctggagagggggctcaggtccacccttggctatccttggttgtacagttgcatctacttataacggtggccaagtcgccatggcagtaggtgctgtggctgccctgccccatcgtcttcagactacccgagtttacctgcagcactgacagcttcccaccccaaaactcctcgttctttgcttttcctctcggtggctttctccaggggctgtaggagcttgtttagcccacctgcatggcattttgaaaatacctgaaattttatgccccgaaggacaattctcaatcagtgaaagatgggagaggaaaggtaaacacctcagctgccccatctctcagtgggacaatgttgaggggtcgtctttgtgttctctcaagggtcctcagcaagaccgagccacccgtcacccacagcagtaacatactcatgagcacgcccccccaccccaccttttgtgcttcctgggatcacttcccaaataaactacttgcacct

SEQ ID NO: 2121 - DNA, 3020 bp, Homo sapiens
  ENST00000371435
gctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaaaaggcagtggcaagtaagttatagaagagaaatgctgctagaaggaattaagcgttgtagtaaatgcgtgcttatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaaaaataaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaactgtatctttctttttctgatttaataaaaaatacatttacttctaaa

SEQ ID NO: 2122 - DNA, 3303 bp, Homo sapiens
  ENST00000395961
gtattcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatgtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgtcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaaaaggcagtggcaagtaagttatagaagagaaatgctgctagaaggaattaagcgttgtagtaaatgcgtgcttatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaaaaataaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaactgtatctttctttttctgatttaataaaaaatacatttacttctaaa

SEQ ID NO: 2123 - DNA, 882 bp, Homo sapiens
  ENST00000422805
agaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaattcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgag

SEQ ID NO: 2124 - DNA, 1299 bp, Homo sapiens
  ENST00000369541
tgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactttgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgtgtcatagaattaattttcagccatgtggaccatattttgtatccaaggatccttatttaaagctttcaacatgtacaggaagttggaaatttttggtttatgactttgtctaataaagagatagttctaaacacattcttgatcaccaaacaacttcagaaagacagtgactgtacagttatcattatcatcatcatcgtcatcatcataggtaacagttatatcaagcttaatatgtgctgaacattgttctgaacactttaggtagatgaactagatgtatgtgaataaaaattatttggtcctcacaaaaa

SEQ ID NO: 2125 - DNA, 891 bp, Homo sapiens
  ENST00000485021
cagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactttgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgacttt

SEQ ID NO: 2126 - DNA, 2454 bp, Homo sapiens
  ENST00000264381
gagctttgtcagtaacagttgattgttacattcagtaacactgaatgtcagtgcagtccaatttacaggctggagcagcagctgcatcctgcatttccccgaagtattacatgattttcactccttgcaaactttgccatctttgttgcagagaatcggaaatcaatatgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacgtgtttaattaaatttcacaatataaagttctacagttaattatgtgcatattaaaacaatggcctggttcaatttctttctttccttaataaatttaagtttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatca

SEQ ID NO: 2127 - DNA, 2522 bp, Homo sapiens
  ENST00000497011
agtaacagttgattgttacattcagtaacactgaatgtcagtgcagtccaatttacaggctggagcagcagctgcatcctgcatttccccgaagtattacatgattttcactccttgcaaactttgccatctttgttgcagagaatcggaaatcaatatgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggctgaggagtaggaggaggggaaaaggagctgttggtctcgctgtctctggattgacagaggtggaagaaaatccacatgaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacgtgtttaattaaatttcacaatataaagttctacagttaattatgtgcatattaaaacaatggcctggttcaatttctttctttccttaataaatttaagtttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatc

SEQ ID NO: 2128 - DNA, 2527 bp, Homo sapiens
  ENST00000482958
agtaacagttgattgttacattcagtaacactgaatgtcagtgcagtccaatttacaggctggagcagcagctgcatcctgcatttccccgaagtattacatgattttcactccttgcaaactttgccatctttgttgcagagaatcggaaatcaatatgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatggctgttcttcctcaaccatactaaactacgttcttgaaacagaacctgtggttttgatttgatattcattgaagtactatgatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacgtgtttaattaaatttcacaatataaagttctacagttaattatgtgcatattaaaacaatggcctggttcaatttctttctttccttaataaatttaagtttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatc

SEQ ID NO: 2129 - DNA, 702 bp, Homo sapiens
  ENST00000479451
gcagtccaatttacaggctggagcagcagctgcatcctgcatttccccgaagtattacatgattttcactccttgcaaactttgccatctttgttgcagagaatcgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacgtgtttaattaaatttcacaatataaagttctacagttaattatgtgcatattaaaacaatggcctggttcaatttctttctttccttaataaatttaagtttttccccccaaaa

SEQ ID NO: 2130 - DNA, 739 bp, Homo sapiens
  ENST00000488954
gcagtccaatttacaggctggagcagcagctgcatcctgcatttccccgaagtattacatgattttcactccttgcaaactttgccatctttgttgcagagaatcgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacagagcctatatgctgctactgtgagccaggaactgcactagcagctagagctgcacagatgaaaatgacagggtctgcttactcacagtgaagtggagtcagggcccaggaccatggaaagcttttaagaagagaagatacctgcactgaatctcaatgtgaaggcaaagtggagagaagccagataagcaggaaccagagatgaagtgtcttgtgcatcatgctaaagaatttaaattatattctgagtaaagccatttagtaattttaaatgagaaactgatatgttctggttattgattcataaatgtataatcttttactatattcacgagttattcttttttacctttgtcttcttagagtctagattgtaagaatattatatggcatcaacataataatttcatttctgaggtagggtctttcttccaaatagctgcttttgtttgctggttcattcgcat

SEQ ID NO: 2131 - DNA, 3959 bp, Homo sapiens
  ENST00000356842
tttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 2132 - DNA, 2427 bp, Homo sapiens
  ENST00000359629
tttttttcatctctctctctctctctccctctatctctcttctctctctctccctctttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 2133 - DNA, 1508 bp, Homo sapiens
  ENST00000489516
gcggatcagacgcggcgcgcggcggtgtgaagttacagcccggccagccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctacc

SEQ ID NO: 2134 - DNA, 567 bp, Homo sapiens
  ENST00000479026
gaaaaaatggcacagtgatcgagtgttgaataatgatataaaaactgaatagaggttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtg

SEQ ID NO: 2135 - DNA, 2316 bp, Homo sapiens
  ENST00000631857
tttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcaggtaacccaagggggagctcagagaagagtccaggctgccagtgcaaaggtccagccctgtcgccaaggagaccctcagggaaatgcacaggcctccagctattcccacggcccctgtagctgagcgccagcttcttcctgggccaagctgaggctgtttcctgccgtgtccattctcctagcaacgcttctctttggccagtttgccatagtacctgagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcggagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgcta

SEQ ID NO: 2136 - DNA, 562 bp, Homo sapiens
  ENST00000492272
ttttcaatcttctgggaaagagaagaatgttcccctccagttctgggcatattgaaggagcacggagctgttgggaaaagttgcaatgctaacatagacctccactgagagaatttcagaatcatttggtagttgagaagcgcctacttcatgcggaggccccgtgggaggagtggaagagttggcctcagcactggcgagtatcggatgggagctctgctcacttgataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttcttcacacacccccattcggcgtagtacccagagagctcaagatgtgtggcagttttcggatggaagctcgagagcccttaagttct

SEQ ID NO: 2137 - DNA, 5942 bp, Homo sapiens
  ENST00000335712
ttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttttcctttatgttctcaccgtttgaatgcatgatctgtatggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttattttttttaaacaatgattaaattgaatgtgtaatgtgcaaaagccctggaacgcaattaaatacactagtaaggagttcattttatgaagatatttgctttaataatgtctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaactaaaaaaaaaaaaactttgccagccatttacttgactattgagcttacttacttggacgcaacattgcaagcgctgtgaatggaaacagaatacacttaacatagaaatgaatgattgctttcgcttctacagtgcaaggatttttttgtacaaaacttttttaaatataaatgttaagaaaaattttttttaaaaaacacttcattatgtttaggggggaactgcattttagggttccattgtcttggtggtgttacaagacttgttatccatttaaaaatggtagtggaaattctatgccttggatacacaccgctcttcaggttgtaaaaaaaaaaaacatacattggggaaaggtttaagattatatagtacttaaatataggaaaatgcacactcatgttgattcctatgctaaaatacatttatggtcttttttctgtatttctagaatggtatttgaattaaatgttcatctagtgttaggcactatagtatttatattgaagcttgtatttttaactgttgcttgttctcttaaaaggtatcaatgtaccttttttggtagtggaaaaaaaaaagacaggctgccacagtatatttttttaatttggcaggataatatagtgcaaattatttgtatgcttcaaaaaaaaaaaaaagagagaaacaaaaaagtgtgacattacagatgagaagccatataatggcggtttgggggagcctgctagaatgtcacatggatggctgtcataggggttgtacatatccttttttgttcctttttcctgctgccatactgtatgcagtactgcaagctaataacgttggtttgttatgtagtgtgctttttgtccctttccttctatcaccctacattccagcatcttaccttcatatgcagtaaaagaaagaaagaaaaaaaaaggaaaaaaaaaaaaaaaccaatgttttgcagtttttttcattgccaaaaactaaatggtgctttatatttagattggaaagaatttcatatgcaaagcatattaaagagaaagcccgctttagtcaatacttttttgtaaatggcaatgcagaatattttgttattggccttttctattcctgtaatgaaagctgtttgtcgtaacttgaaattttatcttttactatgggagtcactatttattattgcttatgtgccctgttcaaaacagaggcacttaatttgatcttttatttttctttgtttttatttttttttttatttagatgaccaaaggtcattacaacctggctttttattgtatttgtttctggtctttgttaagttctattggaaaaaccactgtctgtgtttttttggcagttgtctgcattaacctgttcatacacccattttgtccctttattgaaaaaataaaaaaaattaaag

SEQ ID NO: 2138 - DNA, 2775 bp, Homo sapiens
  ENST00000477659
aatattcttcgatagcagttcaaatgaaatccccacagcagagagcttttgggtctagcagtggagcgataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttttcctttatgttctcaccgtttgaatgcatgatctgtatggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactg

SEQ ID NO: 2139 - DNA, 2697 bp, Homo sapiens
  ENST00000358510
tctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcaggtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaaca

SEQ ID NO: 2140 - DNA, 756 bp, Homo sapiens
  ENST00000409351
ttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagctcagactgaactggaggatgtatttgtgtaccttatggtgtaattgtaaatgagactataaattatagtatgctattatgactacttatttttcttttctctttatttatgtgattctgaataaaaacgactgacttctg

SEQ ID NO: 2141 - DNA, 372 bp, Homo sapiens
  ENST00000489183
acattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagcaggatgtgggaatgaccatttccatgtgttgtcttgtgactggaaggaaaatgaacagaagtgtaaggcatgattaatgaagcaagagcaggcggaaggggatttgtcgtcttcggagatccaaagccttgctaaatcaccaaatatggagtaacacttgc

SEQ ID NO: 2142 - DNA, 7559 bp, Homo sapiens
  ENST00000357195
tgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcagggccgtgcaggcctgcccagctgccagcggtggcccccatagctgcctcctcccaccctcactcatccgtgatcacttcacctctgcgtgccctgggcgctctcccgccctgcctccccctgccgtgctgcagcgcgcgcccggtctcgggtgacgggactcagggtgagggtcagacggaggctccctttggatgccagtgtcagttgtcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 2143 - DNA, 7603 bp, Homo sapiens
  ENST00000345514
ttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 2144 - DNA, 2599 bp, Homo sapiens
  ENST00000443726
tttttttttgcctctttttcttattttagatcgagaggtttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcacccgtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagta

SEQ ID NO: 2145 - DNA, 7559 bp, Homo sapiens; identical to SEQ ID NO: 2142
  ENST00000357195

SEQ ID NO: 2146 - DNA, 7603 bp, Homo sapiens; identical to SEQ ID NO: 2143
  ENST00000345514

SEQ ID NO: 2147 - DNA, 2599 bp, Homo sapiens; identical to SEQ ID NO: 2144
  ENST00000443726

SEQ ID NO: 2148 - DNA, 4532 bp, Homo sapiens
  ENST00000439476
gcgcgcgcgcacacacacacacacacacagagagaacatctctagtaaaaagaaaagttgagctttcttagctagatgtgtgtattagccagaaaaagccaaggagtgaagggttttagagaactggaggagataaagtggagtctgcatatgggaggcatttgaaatggacttaaatgtctttttaatgctgactttttcagttttctccttaccagacacattgttttcatgacattagccccaggcatagacacatcattaaaatgaacatgtcaaaaaatgatttctgtttagaaataagcaaaacattttcagttgtgaccacccaggtgtagaataaagaacagtggaattgggagccctgagttctaacataaactttcttcatgacataaggcaagtcttctatggcctttggtttccttacctgtaaaacaggatggctcaatgaaattatctttcttctttgctataatagagtatctctgtgggaagaggaaaaaaaaagtcaatttaaaggctccttatagttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2149 - DNA, 4766 bp, Homo sapiens
  ENST00000525528
gcgcgcgcgcacacacacacacacacacagagagaacatctctagtaaaaagaaaagttgagctttcttagctagatgtgtgtattagccagaaaaagccaaggagtgaagggttttagagaactggaggagataaagtggagtctgcatatgggaggcatttgaaatggacttaaatgtctttttaatgctgactttttcagttttctccttaccagacacattgttttcatgacattagccccaggcatagacacatcattaaaatgaacatgtcaaaaaatgatttctgtttagaaataagcaaaacattttcagttgtgaccacccaggtgtagaataaagaacagtggaattgggagccctgagttctaacataaactttcttcatgacataaggcaagtcttctatggcctttggtttccttacctgtaaaacaggatggctcaatgaaattatctttcttctttgctataatagagtatctctgtgggaagaggaaaaaaaaagtcaatttaaaggctccttatagttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcaggtttatatgctagatcttgggggaaacactgcatgtctctggtttatattaaaccacatacagcacactactgacactgatttgtgtctggtgcagctggagtttatcaccaagacataaaaaaaccttgaccctgcagaatggcctggaattacaatcagatgggccacatggcatcccggtgaaagaaagccctaaccagttttctgtcttgtttctgctttctccctacagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2150 - DNA, 3979 bp, Homo sapiens
  ENST00000395986
acacggctacctgctccccaggaattgagactgaagtggacttacaagtccgaagccaatgtagcttggaaaacttgggaggcggaattcctaccgctgggaactgaaagggtctgcgacactctcgggcaggccgaacccacatctctacccatcctgcgcccctcttctgaagcgccctccagggaagttaagagttttgactttcggggagtggttgggatgtacgtgggggattcttgactcgggttagtctctggggatgcagagccgggaagaggaatggttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2151 - DNA, 3878 bp, Homo sapiens
  ENST00000533131
acacggctacctgctccccaggaattgagactgaagtggacttacaagtccgaagccaatgtagcttggaaaacttgggaggcggaattcctaccgctgggaactgaaagggtctgcgacactctcgggcaggccgaacccacatctctacccatcctgcgcccctcttctgaagcgccctccagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2152 - DNA, 4018 bp, Homo sapiens
  ENST00000356660
agagctaaataatgtctgacccgggcgcaaggcgcagcctggagctccgggtccccgacgctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgaggtttgtgtggaccccgagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2153 - DNA, 4125 bp, Homo sapiens
  ENST00000418212
agagctaaataatgtctgacccgggcgcaaggcgcagcctggagctccgggtccccgacgctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgaggtttgtgtggaccccgagcatgagcagagatcattaaaaattaaacttacaaagctgctaaagtgggaagaaggagaacttgaagccacaatttttgcacttgcttagaagccatctaatctcagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2154 - DNA, 4000 bp, Homo sapiens
  ENST00000533246
agagctaaataatgtctgacccgggcgcaaggcgcagcctggagctccgggtccccgacgctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2155 - DNA, 3918 bp, Homo sapiens
  ENST00000530861
agagttgaaagctaggggagcgagacctcggggcgtgcgattctcactcgctccctcccgccccagcgcccacagccggggtttctgcagagggcgcgggacgcggggttccccggggctgaggctggggctggaacacccctcgaagccgcgggcgtcctgtccaaggcgccccaggagggcgcaggactcgcagggcgatgtcgcggggccctaggggaggagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2156 - DNA, 4176 bp, Homo sapiens
  ENST00000530786
gtaaaccaatagcccccatgctctgtgcgatttcattgtgtgctcgcgttcgcaagctccgtagtgcaggaaggtgcgggaagttaagtaattaaaagaaattatagagtgggatgcaaaaataacccgaaggacaactggatgtgtggagccaccagttttctccatgagtgcacaaggttaatccttgttactactcagaatgctgagtttctacagaaagggttgcaggtccacacatgttttggcgtctacccacacgcttctgtatggcatgactgtgcatcccagaagaagggctgtgctgtgtacctccacgtttcagtggaatttaacaaactgatccctgaaaatggtttcataaagggatggtaataaagtctcttagtggttgaaaatgttatttcttacaaaagtggagaacatttgcttttcaataccagagttttcagccatttctgcattctgacctattgactggagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2157 - DNA, 3776 bp, Homo sapiens
  ENST00000395983
gtaaaccaatagcccccatgctctgtgcgatttcattgtgtgctcgcgttcgcaagctccgtagtgcaggaaggtgcgggaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2158 - DNA, 4059 bp, Homo sapiens
  ENST00000438929
gtaaaccaatagcccccatgctctgtgcgatttcattgtgtgctcgcgttcgcaagctccgtagtgcaggaaggtgcgggaagttaagtaattaaaagaaattatagagtgggatgcaaaaataacccgaaggacaactggatgtgtggagccaccagttttctccatgagtgcacaaggttaatccttgttactactcagaatgctgagtttctacagaaagggttgcaggtccacacatgttttggcgtctacccacacgcttctgtatggcatgactgtgcatcccagaagaagggctgtgctgtgtacctccacgtttcagtggaatttaacaaactgatccctgaaaatggtttcataaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2159 - DNA, 4030 bp, Homo sapiens
  ENST00000584049
acccactttcccattcaccgcggagagggctgctctcgctgccgctccccccggcgaactagcatgaaatctccctgcctctgccgagatcaaatggagcttctcgctgatggggtgcgagtattacctccgccatgcaatttccactatcaataatttaacttctttgctgcagaacagaaggagtacataccgggcaccaaagactcgcgccccctcccccctttaattaagcgaagggaacgtgaaaaaataatagagtgtgggagttttggggccgaagtctttcccggagcagctgccttgatggttactttgacaagtagtgactgaaaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2160 - DNA, 3930 bp, Homo sapiens
  ENST00000532997
cttccaccccgccccctcctccagcctccatccctccctcattctatctcttcctctccgtcgccctcgctcctcgctggatgcttctttctgggttttcttttttttttcccttctgtcctccctccccgcgagtttcgggcgctggcttagagggttcccgctttctcaagggaaggggagctgccgagaccgcgctccgctccccagccgggccggatgcctcactgagcccagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2161 - DNA, 4071 bp, Homo sapiens
  ENST00000395981
gtgtgtaatccgggcgataggagtccattcagcaccttggacagagccaacggatttgtccgaggtggcggtacccccaggtagtcttcttggccccgctgtaaagccaaccctgtgtcgcccttaaaaagcgtcttttctgaggttcggctcacactgagatcggggctggagagagagtcagattttggagcggagcgtttggaaagcgagccccagtttggtcccctcattgagctcgctgaagttggcttcctagcggtgtaggctggaatagactcttggcaagctccgggttggtatactgggttaactttgggaaatgcaagtgtttatctccaggatctagccaccggggtggtgtaagccgcaaagaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2162 - DNA, 3988 bp, Homo sapiens
  ENST00000395978
gtgtgtaatccgggcgataggagtccattcagcaccttggacagagccaacggatttgtccgaggtggcggtacccccaggtagtcttcttggccccgctgtaaagccaaccctgtgtcgcccttaaaaagcgtcttttctgaggttcggctcacactgagatcggggctggagagagagtcagattttggagcggagcgtttggaaagcgagccccagtttggtcccctcattgagctcgctgaagttggcttcctagcggtgtaggctggaatagactcttggcaagctccggttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2163 - DNA, 3829 bp, Homo sapiens
  ENST00000525950
aatatcaagtatcacttaattagagatttttaagccttttcctcctgctgtgccgggtgtgtaatccgggcgataggagtccattcagcaccttggacagagccaacggatttgtccgaggtggcggtacccccagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2164 - DNA, 4340 bp, Homo sapiens
  ENST00000314915
attattaaagcggtagtctgccggcgctgataagcaacaagttccccagcggtcttcccgccctagcctgacaaggcgaaggttttcttacctggcgacagggaaatctcccgagccgaattcagcttcgccggagccccaggtgtgacctgcgtagtgggcaagggagcggtgtgcaggctgagtttttttttttacaggggtaccctgaaactcctcactttctctgggaactttcagtgccaggacccagtaacgggcggttagaaggcagccctaggaaacacctgctacatagcagggcagttgggcaatcattggtaacctcgctcattcattagaatcacgtaagaactcaaaaggaaacgtgtctctcggagtgagggcgtttgcgtaaatctataggtttttcgacatcgatgccagttgctttgtcttctgtagtcgccaaggtggttgagagtttaagcttgcggatattgcaaagggttattagattcataagtcacaccaagtggtgggcgatccactgagcaaagccgaacttctcacatgatgacttcaaacaagacacattaccttccagcatctgttggggagacgagattttaagacacttgagtctccaggacagcaaaggcacaatgttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 2165 - DNA, 4030 bp, Homo sapiens; identical to SEQ ID NO: 2159
  ENST00000395980

SEQ ID NO: 2166 - DNA, 4176 bp, Homo sapiens; identical to SEQ ID NO: 2156
  ENST00000420794

SEQ ID NO: 2167 - DNA, 1988 bp, Homo sapiens
  ENST00000536005
gacgcccgagcccgagcgcagtggcctccgagcgggaaccggactgggagccggagccggggcgggaaccggagctggagccgaagctggagccggcactgcggcgcacggagcggagcgctgcagccaagccgagtgagtggaggggccttccctgcgagaagtcagagctgtgcccgtgggcaggctggctccgctgttctgctccaaggattacatgtccttcaaacgtccctgccccttagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggctacgaggagtgtgtggggccaggggccactcagctgtatgtccccacggacgcaccaccaccctactcgctgactgattcctgccccacgctggatggcacctccgactcaggcagcggccacagccctggccgacaccagcaggagcagaggaccccggcccaaggtggccttcacacggtctccatggacacccttcccccctacgaggctgtgtgcggggctggccccccatcaggcctgctgccactgccgggcccagacccagggccaaggggctcccagggctcacccaccccaacccgggccccagcctctggcccagagaggattgtgtgagggacccagccagccgggtcctgctggtccctacaggctgaaccacattctttaggcacacaaaggcgtgcacacacacacagagatgcacacgtgactcataacacacacatagaccaaacttgtatacacacagacatctacactgacataccccatgtacacacacagatctagacgtgctccacatatgtgtgaatatgcgcacatacaggcctaccacaaacacaaaacccacctgcaaaggtttcacggaacgtggagctctcctggcctcccgtccctcctcccggcctgtttgttgtgcctctgtagagagcgcttcggagagagaggcgaagtaggaagtgggattttctcttccctctcctgggcccgtttgcccctaccctcgcccagcaagctgcgcccaaattctattctgcctctggaaactgctggaccatccaaggtcagctgcctgccctgacccctaccccagggccagcttgtcctcctgggaggcgggacaggccccagtgaggttccgttgtgcgctgtgcctatctctcgattccagggcagatgagccacaacatcaccaccctgccacttacaaggtgggggacctgggtctggggtctcaggcgcaaactggaggccctcacagcccactaggccccctcccaaccccagtaccctcagtccctcagtcaggtggtgctagtagagctatctctgacgctgcaggccccaggtagatgggcagggccctccgtgggtgtgcagcggcggttccctcatcagtccagccactgcccaggactaagggtcttcaaggaagatgaggccattgcccttctccaggtggcttcaccacagtgctgcctgggcacctctctgaggcagagaagtggcccctccctcagtccctgcctggccgaccactgtggcctgcacgcgaatgggtcagagccagaccccggagctggtgctgtccttctaggtggct

SEQ ID NO: 2168 - DNA, 2469 bp, Homo sapiens
  ENST00000562849
ggactgggagccggagccggggcgggaaccggagctggagccgaagctggagccggcactgcggcgcacggagcggagcgctgcagccaagccgatagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggctacgaggagtgtgtggggccaggggccactcagctgtatgtccccacggacgcaccaccaccctactcgctgactgattcctgccccacgctggatggcacctccgactcaggcagcggccacagccctggccgacaccagcaggagcagaggaccccggcccaaggtggccttcacacggtctccatggacacccttcccccctacgaggctgtgtgcggggctggccccccatcaggcctgctgccactgccgggcccagacccagggccaaggggctcccagggctcacccaccccaacccgggccccagcctctggcccagagaggattgtgtgagggacccagccagccgggtcctgctggtccctacaggctgaaccacattctttaggcacacaaaggcgtgcacacacacacagagatgcacacgtgactcataacacacacatagaccaaacttgtatacacacagacatctacactgacataccccatgtacacacacagatctagacgtgctccacatatgtgtgaatatgcgcacatacaggccccagtgaggttccgttgtgcgctgtgcctatctctcgattccagggcagatgagccacaacatcaccaccctgccacttacaaggtgggggacctgggtctggggtctcaggcgcaaactggaggccctcacagcccactaggccccctcccaaccccagtaccctcagtccctcagtcaggtggtgctagtagagctatctctgacgctgcaggccccaggtagatgggcagggccctccgtgggtgtgcagcggcggttccctcatcagtccagccactgcccaggactaagggtcttcaaggaagatgaggccattgcccttctccaggtggcttcaccacagtgctgcctgggcacctctctgaggcagagaagtggcccctccctcagtccctgcctggccgaccactgtggcctgcacgcgaatgggtcagagccagaccccggagctggtgctgtccttctaggtggctgctcatagctggggatggtgagtggctgtgttctggccttgcccacgtgggtgtttgcagagacaaaatgaaggggatatgctccccataaataccaccttgccaccacaagaggaccagaaggctactcagccttgctgccacagaaggggatttgtagggtcagcctggctgcagaaaggctggctcagatcttgaccaagaaaccccagcgatttccatcaaagaccacgcaggtaacagaggtgattcctgaagacccagcccacagagggtggcagccaagcatctctgagcagtgtccctgctagcatcgccagcggccatcactctgcctccctcccacctcttgtccctcgtcgttaaaaaacagcaccctatcctgcttccccacatttctgttcctccaatgaagggctaagactatttagtaatctctttcttaagcagaggagtggcaaggatggcaatcttgaattttattttctgtagagatagcatttcttctggtgcggagctgaaaggaatccacccagaagttctgtagcatcctgcgtgcagcctcctggagccccagactccatctgggggagggacttgtttacaagcagttctgaccaccttagtggtgtactgttttctaggcaaaaaatatctgtctgttgtactgtatagcctttaaaatgcagtccaggaatgagactcttttaagaaacacatcctgcttctgcaattccagagagtgctgggggaaaaaaagggataaaaattcctacctactcatcagtgtttgaaagatggagctgaatagcttttcttgttcctggactaggcaatgaataagcaacaatgtatcttttctgtgttcaaaataaatacataatatcaataaaatgtagcaagaagtaacactttcagagagtgca

SEQ ID NO: 2169 - DNA, 2160 bp, Homo sapiens
  ENST00000299694
ctggagccgaagctggagccggcactgcggcgcacggagcggagcgctgcagccaagccgatagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggctacgaggagtgtgtggggccaggggccactcagctgtatgtccccacggacgcaccaccaccctactcgctgactgattcctgccccacgctggatggcacctccgactcaggcagcggccacagccctggccgacaccagcaggagcagaggaccccggcccaaggtggccttcacacggtctccatggacacccttcccccctacgaggctgtgtgcggggctggccccccatcaggcctgctgccactgccgggcccagacccagggccaaggggctcccagggctcacccaccccaacccgggccccagcctctggcccagagaggattgtgtgagggacccagccagccgggtcctgctggtccctacaggctgaaccacattctttaggcacacaaaggcgtgcacacacacacagagatgcacacgtgactcataacacacacatagaccaaacttgtatacacacagacatctacactgacataccccatgtacacacacagatctagacgtgctccacatatgtgtgaatatgcgcacatacaggcctaccacaaacacaaaacccacctgcaaaggtttcacggaacgtggagctctcctggcctcccgtccctcctcccggcctgtttgttgtgcctctgtagagagcgcttcggagagagaggcgaagtaggaagtgggattttctcttccctctcctgggcccgtttgcccctaccctcgcccagcaagctgcgcccaaattctattctgcctctggaaactgctggaccatccaaggtcagctgcctgccctgacccctaccccagggccagcttgtcctcctgggaggcgggacaggccccagtgaggttccgttgtgcgctgtgcctatctctcgattccagggcagatgagccacaacatcaccaccctgccacttacaaggtgggggacctgggtctggggtctcaggcgcaaactggaggccctcacagcccactaggccccctcccaaccccagtaccctcagtccctcagtcaggtggtgctagtagagctatctctgacgctgcaggccccaggtagatgggcagggccctccgtgggtgtgcagcggcggttccctcatcagtccagccactgcccaggactaagggtcttcaaggaagatgaggccattgcccttctccaggtggcttcaccacagtgctgcctgggcacctctctgaggcagagaagtggcccctccctcagtccctgcctggccgaccactgtggcctgcacgcgaatgggtcagagccagaccccggagctggtgctgtccttctaggtggctgctcatagctggggatggtgagtggctgtgttctggccttgcccacgtgggtgtttgcagagacaaaatgaaggggatatgctccccataaataccaccttgccaccacaagaggaccagaaggctactcagccttgctgccacagaaggggatttgtagggtcagcctggctgcagaaaggctggctcagatcttgaccaagaaaccccagcgatttccatcaaagaccacgcaggtaacagaggtgattcctgaagacccagcccacagagggtggcagccaagcatctctgagcagtgtccctgctagcatcgccagcggccatcactctgcctccctcccacctcttgt

SEQ ID NO: 2170 - DNA, 1078 bp, Homo sapiens
  ENST00000561796
ctggagccgaagctggagccggcactgcggcgcacggagcggagcgctgcagccaagccgatagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggggtctcactcagtcgcctacgctggagtgcaatgatgtacactgggagctttacctactgggtgcgatctatgctttccagacacaaactggacgccatcctgggcaggctgggctacacggccaccttggagtctgagttctcactggtccaggccatcagcaaagagaatgtcaagcagatggtgttcaagatcttcctggtgagggtctcatgtgaagccgttctcagaaccgcgggcacacggatgcttgagccgggcacagagaaactcgctaggacccacagcaggcacagctcagagaaaaggctggtgaagccctgcagctgcctcgagggggttcagccaggcccaggttccgggggaccacagcaaggtccctcagaaggggtggggtccgagacggccctggcagagggcactgctggccagagatctctgcccatggctctgagcccatctgaggtctcaacagcccccaacagcctccccagtggctctccagtcctctagggcccccagtgccatggcagcacatgcctggacagtgaggaggtcctgccttgcttcagtgaccctgtcttacactggatgccctggt

SEQ ID NO: 2171 - DNA, 963 bp, Homo sapiens
  ENST00000569272
ctcgagtccccgacgagcatcaaccgcatttggggaacccaagacagcctccccagcagcttgccctcggtttcggggacccctgaacaacccaaccaagaagggaaaactagggcgcactctcggtcggggtgggagaggaaaggggctggggcttcacggagtttggagtttgaacccacccgcacccctttgagctaggaagtttgacccttcgacgagcaggtcgcctggggtatgcccctgtctccgtgcctctgtctcagcaccgagcgtcggagagagagcgcgccctccgcaccttctcccactttgggacagactttcccttgcgctgtcagagggacccgaggctgagtacgaggcgaggcggcaggcagctcaggctggctgcgcagcgctgagtggcaccgccgccgctccccaggggcagggcccaccccacacccggctgactctcgctgcccttcctccttccctatcgggctctgcggtctggaggctggagagcggtgaggaccagggactgccctgtccatctcgggcgggtgccggcgtgggtggcggggcgcaggctgggaaagggagggcgcaagtaactggtgtgagaggcaggggttcagggatccttgctcttgagccacgatttccgatgagcccctgccgagagcatgccgctctggactcactcctcaaacataactgctctgctggaacgagagacttcaccaccctgtgcctcagtttcctcatctgaaatggaggggccttccctgcgagaagtcagagctgtgcccgtgggcaggctggctccgctgttctgctccaaggattacatgtccttcaaacgtccctgcccctgtaagtttcctccccacatccttccaccacttggggccaggcaagggcagagcttggagtcgagctgcagagaacggcttgaggtgtttggccaaagaactg

SEQ ID NO: 2172 - DNA, 437 bp, Homo sapiens
  ENST00000618932
gaggctggagagcggtgagtggaggggccttccctgcgagaagtcagagctgtgcccgtgggcaggctggctccgctgttctgctccaaggattacatgtccttcaaacgtccctgcccctgtaagtttcctccccacatccttccaccacttggggccaggcaagggcagagcttggagtcgagctgcagagaacggcttgaggtgtttggccaaagaactgcaggggtccaaccagaggctaatgtggcatgctgggtggggagagggcaacacggaagacccctgacgtctgcaagatgctccctgagaactgaaaatcgcactttggcccattcttctgtatcagcccttcccgaagtgtggatcggagttcctctgagggatgttaatgggatgacacacacccacacacaaataaaagactacatggccaa

SEQ ID NO: 2173 - DNA, 2929 bp, Homo sapiens
  ENST00000564819
catcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggacagggtctcactcagtcgcctacgctggagtgcaatggtatgaacatagctcactgtagccttgaactcctgggctcaagtgatcctcccacctcagcctcctaagcagctgggactacaggcatgcaccaccatacccagctaatttttgattttgaatttttgtaaacacagggtctcactatgttgcccaggctagttgaaactcctggtctcaagcgatcctctcacctcagcctcccgagtagggtttataccttctgaaacttgtaagaaaaggaaacactaaatagcaacaaaatgaaaatacacctccggctagcaatctctacccattcattacctctcaagattaagcaccattgaagccttgtcattttcctgttgatgtggatatttggatagtcagtgccttacaggagttgcttttttttttttaacctcactgaaacttggcatcatttctctgagacatggctggtgtaacgtcatgaggatgggccatcaacttcaggacctgactctaggaacttcagagactacacgttttactctaacaggagttggcttgtagcaccctgatggcttgtaccaccaggaaagagaggaaagtggcaatgaaactgaaatgagctgttgtctcaccctctgcaggaattcccctcttcctttccatgccctccacaacaccatggcttgggctattgatctcttagcggacagagcctgggccccttcctctgtcacatttccctcccaccagaactccaatagagcccactaacatagtcctagatgcccccaagtgccttgaaagtggggtgcaatccaaaattcgaatagtccattaatatagtcttagaccccaagtgccttgaaagtggggtgcaatcctgaaggagggtgcagcggggggaaagaccacgagataggctcatccttctggttctccagcccacgtccctgctggacaggccaaggctggctctgctgcgcctatcacccccaccctgagcccacactgccacctgccggctcgctgctgccactgctcaaagtgaacaagtcaggccctgaagaatgaggaagcccctcctctcaccttgaaacacaatacccaccagcactcataattgcagacaaaacccgtcattttaaccctgggcttttcttccacccttgagatgttctatgaggttgaacccattcaagtattccatttttggggctcacccccgccccgccagcatcactctctggacaaagcctgacacttatgtccccctctctgtaagcaaaataatcattttgcatgccctctgttctgaacatcactaggcatggctctggtgccacctcagtgctctggggctccacctcctgggaatgaatgcagaaacttccacagtgatggtgtccagccatgtgctgcccccaaccgaaaccaccccacaccgacacccagctcccaccacaaagacttaggatcccacaggcctttgggactgtcacgctcttggcttttcctgctcctccatccacgacatgccctatgctgtggtgtgtcacatatggcaccacattcaaggtcctttgcacattcctaaggagatgccgcctgtctgtgccaggggccaaggagaacaccccaggtacctgggctcatcagaggcccaaggagatggaaggtgaagctgcatcacaggacgatggagacaggggccccagggccagaccctgggatgaggatgtgggtgagagtttggttagggaagtgttcccaggagtaccagatggagtgaggcaggaaacaagaaaggcaaggaagccagtgagggggtcaccaagcaggtcaccactgcaggccactgagcgcagtcccactggtgactctgagacacagagtagaacgcacctcaaagtgacgcccgccctcaggtgggagagacgggttgtttgtaccctgatgctcagcagacatttttggaggctgccctttggagaatgttcattcctgccccttgtggaggccaaatgggctcctctggccagaaaaaagtcttcaggggagtcaccgtgctggcgatgacgccatcgtgatagtccacaagagccatcattgggtccccgtgtatgggtgtggtgaggtcccaggtctctgcaaagggctccagcagctgctgccacacacaagcaacaggcatcgcccagaagagggcggaaggagggttgatacagagtaaggctgttcacagccaccacgaggaacatccattgtcacactggccaagcccacatgcacatacacacactggggcccctcccaagttcctagagatacccctggcacacactcacatgtagcatccctcagctccacctcctgtggtttcgtggacatttgctcagacagctttggtgcacacacactagtgcccttctcacttagagcttgtgcacgtacacacttggtgttgcatactccagtgccactgacactcccactcagctgttcctatccatgcccacctgcatgtccaggctcttggcatgagcggtggagagacagtaagcttcatcgtctgaggaagtgaatcttctgtcctggtctctgctttgcttcac

SEQ ID NO: 2174 - DNA, 720 bp, Homo sapiens
  ENST00000563075
catcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgatgtacactgggagctttacctactgggtgcgatctatgctttccagacacaaactggacgccatcctgggcaggctgggctacacggccaccttggagtctgagttctcactggtccaggccatcagcaaagagaatgtcaagcagatggtgttcaagatcttcctggtgagggtctcatgtgaagccgttctcagaaccgcgggcacacggatgcttgagccgggcacagagaaactcgctaggacccacagcaggcacagctcagagaaaaggctggtgaagccctgcagctgcctcgagggggttcagccaggcccaggttccgggggaccacagcaaggtccctcagaaggggtggggtccgagacggccctggcagagggcactgctggccagagatctctgcccatggctctgagcccatctgaggtctcaacagcccccaacagcctccccagtggctctccagtcctctagggcccccagtgccatggcagcacatgcctggacagtgaggaggtcctgccttgcttcagtgaccctgtcttacactggatgccctggt

SEQ ID NO: 2175 - DNA, 644 bp, Homo sapiens
  ENST00000562146
cacccttggacatcagctctgacggggacgtggatgccacggtgctcagggagctgtacccagattctccaccaggatgtacactgggagctttacctactgggtgcgatctatgctttccagacacaaactggacgccatcctgggcaggctgggctacacggccaccttggagtctgagttctcactggtccaggccatcagcaaagagaatgtcaagcagatggtgttcaagatcttcctggtgagggtctcatgtgaagccgttctcagaaccgcgggcacacggatgcttgagccgggcacagagaaactcgctaggacccacagcaggcacagctcagagaaaaggctggtgaagccctgcagctgcctcgagggggttcagccaggcccaggttccgggggaccacagcaaggtccctcagaaggggtggggtccgagacggccctggcagagggcactgctggccagagatctctgcccatggctctgagcccatctgaggtctcaacagcccccaacagcctccccagtggctctccagtcctctagggcccccagtgccatggcagcacatgcctggacagtgaggaggtcctgccttgcttcagtgaccctgtcttacactggatgccctggt

SEQ ID NO: 2176 - DNA, 449 bp, Homo sapiens
  ENST00000566654
tggcaccatctgaactgtgtggtggagtagaagagcatcccttgaaaaggaccctccactccctgccactctgagcctcattatccaactgcaagagtcagaaacccaacttgaatcttcatgagcaaggaagaatacttactgaattgtccaagtcaggcatggctggatccagaaagtccgggaatatgggcagatgtacactgggagctttacctactgggtgcgatctatgctttccagacacaaactggacgccatcctgggcaggctgggctacacggccaccttggagtctgagttctcactggtccaggccatcagcaaagagaatgtcaagcagatggtgttcaagatcttcctggtgagggtctcatgtgaagccgttctcagaaccgcgggcacacggatgcttgagccgggcacagagaaactcgctaggacccaca

SEQ ID NO: 2177 - DNA, 1171 bp, Homo sapiens
  ENST00000622872
gacgcccgagcccgagcgcagtggcctccgagcgggaaccggactgggagccggagccggggcgggaaccggagctggagccgaagctggagccggcactgcggcgcacggagcggagcgctgcagccaagccgagtgagtggaggggccttccctgcgagaagtcagagctgtgcccgtgggcaggctggctccgctgttctgctccaaggattacatgtccttcaaacgtccctgccccttagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggggtctcactcagtcgcctacgctggagtgcaatgatgtacactgggagctttacctactgggtgcgatctatgctttccagacacaaactggacgccatcctgggcaggctgggctacacggccaccttggagtctgagttctcactggtccaggccatcagcaaagagaatgtcaagcagatggtgttcaagatcttcctggtgagggtctcatgtgaagccgttctcagaaccgcgggcacacggatgcttgagccgggcacagagaaactcgctaggacccacagcaggcacagctcagagaaaaggctggtgaagccctgcagctgcctcgagggggttcagccaggcccaggttccgggggaccacagcaaggtccctcagaaggggtggggtccgagacggccctggcagagggcactgctggccagagatctctgcccatggctctgagcccatctgaggtctcaacagcccccaacagcctccccagtggctctccagtcctctag

SEQ ID NO: 2178 - DNA, 2744 bp, Homo sapiens
  ENST00000443071
gcggcgccgggcttcccacggacggggccccgcggggttgcccggccgtgcccgctgtgcccggctctgcccggcgcggccgcggagcgcacgcctcctgcctgctgaccctctcgtttggtttctcgcaggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccggcccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtgg

SEQ ID NO: 2179 - DNA, 625 bp, Homo sapiens
  ENST00000554747
ggccgagcctggccgaggccccggggccgggccttctagcttggcgctgcggccgggctgcgccctcgcccggcggggcggtgggggaggcggcgtggggcccggacccgagcggagcgcgctcccggcggacgcggcggcggcgcccggcgcgaggggccgggatgggcagtcatcagtcttcccaggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcagatggggagtccagaggttctggtaggggaagctcttcctccaaagtcacactatggagcagctgagccaggatttgaacccagcagatctccagacccagactggtccacccggggcccagccatggttccctgggtcctgatgggaaaagctgtgtctagcccggagatgaaccagtttagggacccttcccttgagcgcgtacgggctaatgaagtgtcgatccagttgtgctggactccctca

SEQ ID NO: 2180 - DNA, 354 bp, Homo sapiens
  ENST00000554274
ccttcccatcttcagggggtcccggggtggagggggaaatacagtcctgggccctggcctaggaaaggcttctacaaaagtttgctttaatgggatgttctctgctgtgtgcagaggggcacacattccaccagggtgaagctggtggggtgagctcaggaggtccaaattcagccccaccctgctcagcaggctgtgcggccataagggtcgtgggagggacaggccttgcatggcagtgacccccttgcctcctgcaccaggattcagagcaactacatggcactgcagaggatcaaccaggagctggaggacaagctgtaccgcatgggccagcactatgaggaggagaag

SEQ ID NO: 2181 - DNA, 632 bp, Homo sapiens
  ENST00000554140
cctgcgggaagccgggcggggtgggggagccccggccgcgccggctcccggcgcgctcggcctcggaggggagggggcggcggtagcggcggcggcggtgagcggcgcggctgccctggggccatgtggactggcggtcgccggccgggccggctgcgccgggcggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttcca

SEQ ID NO: 2182 - DNA, 649 bp, Homo sapiens
  ENST00000557378
gcggcgccgggcttcccacggacggggccccgcggggttgcccggccgtgcccgctgtgcccggctctgcccggcgcggccgcggagcgcacgcctcctgcctgctgaccctctcgtttggtttctcgcaggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatcccc

SEQ ID NO: 2183 - DNA, 747 bp, Homo sapiens
  ENST00000554356
ctcttgggaagacccgccctgcccttctctgaggttctcaaaaaccgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcg

SEQ ID NO: 2184 - DNA, 1010 bp, Homo sapiens
  ENST00000556188
ccaggaggggaaagggccaggaaagacaggctccagtgccgtaggatccaggcatgcactgtccgtgtttattgagcgcctgctgtatgctgggacctagcatgagaagcgctgtcatggggacccggaaaggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccc

SEQ ID NO: 2185 - DNA, 925 bp, Homo sapiens
  ENST00000553553
ccctgattgaggagtcgaggctccaaatgccatcgccctcggattgtgcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccc

SEQ ID NO: 2186 - DNA, 5811 bp, Homo sapiens
  ENST00000556751
gctgtttccagacgctggggactccctgacccatctcggcccttgccaggacaccttttcacccagggcaggggacagaggcctctgagccacaggcctccagcagtttcccccagattcccagtggcctggtggccccaccccacacagtgccacctcttgacattgtccactgtgtggagggtgctactatgtagaatgtggaccagcaacagccctgcccccgtgtctgggtgcaccatccagttctgcagatgtggagacaggctgccgtggcagggctcgggttattgcccggtgtggggaacactggacagggaaggaggtactacccgggtgaccgcagaccctaggtacacagcctggactgggcagaggggacacgttcagaggtgtgagaagctgaacccccaggacttagtgacagggctgtgaggggtaaagaggggtcaccatgcccaccccccgggtggggaacgtggagggcagtgaaggtgtggtggatgtggctgcattggacgggttgggtgtggagatgcctgagggccataggtgggtggctggacgtggtgagggtatggagcctgacagacaccccgctggagtcagatggaaacctgggaggggtccctgtgcagctggcttggaggggatttggtctgagcatgcagggcaggggtgcaggtgcaaaccggggccccagggaacagcccgggcgaggtcgggaggggcctgtggtgtgatcgccggaccagcagaggtggggaaagacgtggcaggaaccctggggcggccaagtgcggggcatcagctatgcctggggacggggtgcgtgtccatggcccgatgcctgcagcaagcggacactgaggcagagaggggtgtgagagtcaggggctgggggcactgctagcccaaagattggttgggtgtagcaggtggttgggtgtgaaggacttggggagggggagcagtatttaagggctggtggaacagggagttgactgctgtatctggaaggccatccaaaggccaggggtaaactgaggctctgtgaagctgcctgacttgtgagatgtctgccccgagcccaccccatagccccttcgtcctcccctcccacacctgccccgtggagaatccctgcctagctcattgtctgcctcccctctggaccgcaggctcccggggcaggggcagggtttgtcttactcctggctgtgaggtctcagacaggttgcttgctctgagaggtgagggtagggacctcagggtgcccagaaggggcagggctgggtgagggggcacagtgagctaggggtgcaggtctcagaatagcaaggacctaaggctgctcagtgaggcctggggtgtggctggagaaggggtgaggactcggggctgaggtggccacgtgggtggatggatgacgccctcacctcttcccgagggctgtgggtacaccaggagcccctgcagggaacagtcgacttcaggggctgctgtgcagcccattgtgcctgccctaggagcccaggatggcataggagtccccaggaagttcaccacctccctggggaggacaggtctgtgtgggaagcagcctgggacctgtagctatagagtgctagaagtggggcagccacggaaggctgcctggaggaggtggaaggaggcctgagcactgtcccagagagcgctcccggaggcagacccacgtgggcagctgtggcactttgcctcagggcttccctctttgcttgttactctacttcctcttgtggtgactgactcttgggaagacccgccctgcccttctctgaggttctcaaaaacgtaagcgacgctttatttttatttgtttttaaaaatatagccctgggcaggaatccaagagtgcttcctggaggcttgctgggtgtgtgcccgcagtgccacatgcggtttactcacggggcccagacagaagatgcctctgctcggggctgggggacagtggtggccccagggggactgggagcctcctgcctgccctctactcccctcgcttgggtttgggtcgggaatatcacaagaacgcgggcttttgcccaaggtcccacagcacatctgggcagagtcagggttccaggccctctcccacacctcaagtttccttcatgacacccgggacttctgcctgtcccgtccccatctcacagcaacacaatccaaaagatgttggtcccagatagcccctgggctgtgcacccattgcaaggaaagaactgctggctgctgaccccactctgacccagacaaccggaagtgcagcccctgccttggggagctccgagccatccctgttggaggcccccacactaccctcctgcctttgcacagctttagttcaggtgaattgttggcaggtggctcggaagagtgggtcatagtgggtctctgtttcctgagcatgtggggctctgcatcctggggtcctaccctccaggagaccccattctgggggaagaaaatagagcctcaagaattgtctgggtttctggaaggcttcctggaggaaggggaacttgagcaggccaggaccttgccaggtttcccgtgctgcatgcagcctcattggccatggtggcagacactgcccgggcatgggacattgccaccaaacatctctctggcccagagaagtgacccagggtcccagggccacacagccattttggggaaagcaggtctggtcttgggcatggcactgctgactctgggcctcagccatcccaacctagcactgtggaggagcaggagtgagggccccagtcacctgtgccacccagggccagctctgtgatagcctgggtgctgatgggtgctctttgtacctgggtcctttaaaccgcccccaacacactggccaggttctggggtcaaagactcctccagccaccacctgggatttacctgtgtgagggacactggtggagtctgaggaaccgcccaggccagactggctcagggtcagagtccctgactctggggcgccatggtcttcagtgacgcccgggaggctgggtgtgtgtgagtgtgtgtgtgtgtgtgtgtgtgtgtgtgtgtgcgcgcgcgcgcgcgcgccggtactcgcgtgttagtgcggcacgccccggctggcctgcgggccttagtttcccccgctcagcgccgcggcccggcccgccgccgccatgtcgttgcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccggcccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtgg

SEQ ID NO: 2187 - DNA, 3259 bp, Homo sapiens
  ENST00000637716
atgctctcaggggccagctcccaggcacggggctctaaccctacctgtcccaggcaggacggctacagctccctcctggagcccgggacagaagcccccatcaaggaagctcacagacaggaccttcgaagccacatgccaagccccagccaaggtcggaaccccaagggcaaagcatcttgccaccgctgggcagctcggtccagccaggagatggcccgggtgtcgccagcccagccttcctccccagagtccctgaacacaggcagccgggctgtcactggctccctcgcacgcctgggccgctggcgggaggccagactgcccttctccaggttcctggatgaggtcactgtgcgggttctggaccctgggaccctggaggccttcagggtgcccagaggccgcagcccagagccctctgcagtggatcgaggccaaggtctagcccaggaggcccttacaagagctgcagccccaggggagaaggacccagccctgagctcccagctttcttcggaggcggccactgaggctgcaagcagagtggggccaggccaggccgtgggaactagtgggccttgcttgggcagtggcaagcgtggaggccggactgcctccccttggaggtctccaggtcgggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccggcccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtggaaag

SEQ ID NO: 2188 - DNA, 2674 bp, Homo sapiens
  ENST00000355173
ctgctttgtctgctgtcccctctctgctggagaacttagcccagagctagtgaacgagcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccggcccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtggaaag

SEQ ID NO: 2189 - DNA, 2911 bp, Homo sapiens
  ENST00000637646
gttactcggccgcggcccggcgcgcccactgagtcacgggggccgcggccgggactggaagctggggacgcgcggcgccgggcttcccacggacggggccccgcggggttgcccggccgtgcccgctgtgcccggctctgcccggcgcggccgcggagcgcacgcctcctgcctgctgaccctctcgtttggtttctcgcaggcctctgccgcagacatggagaaactcaggctgcgcagcccctgggtgcccttgtgcctcgggcagccccgagtactgcagggccggctggccaggtcctcgccctccatctgggacagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccggcccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtggaaagaa

SEQ ID NO: 2190 - DNA, 1187 bp, Homo sapiens
  ENST00000547208
tctgggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggtagcagagcagcttatcaacccttttggagaagatgatgatgattttgaaactaactggtgcattgacagaaatttgcagctgtggacgaaatgcacatgagcttacccaagatgaagaaggacatttactgggacgattctgctgctcgcccaccatacacattggcagctgctgactactgcataccctcatttctggggtcaacagtccagatggggaaacagatgcctaagaatgagtggaagatggaagatataaaaatcccactccctcagcctcaattccagtgtgctaagagtgatcctggtggttaaaggtacaacactcgaatctttcaaaacaacttggctcctaaacacaagccaacaatctcatctgctgctcaactgaaaaacattctccactttttagcatccaggcatgtggagttcctaagaaatgcactttattaatgcccaacatggtaccttcccaggagattttaatggtaattttcactctaccagtgttatgtgtgctgactttagggcccacccttcacatatggtattactcactcaagggtttaaactggggcattccagaagtaccagtttccatgatgaaaagtggaacagcagaagcgcttaaagcaattttactgaa

SEQ ID NO: 2191 - DNA, 1506 bp, Homo sapiens
  ENST00000331471
gggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagaaaaaactatccaagatgactgtcacttactccagtaaagtagcaaatgcaactttttttggatttcataggttactcctcaagtggagaggcagcatctacaaactactgtacagggaatttattgtttttgctgttctttatacagcaataagtttggtatacagattgttacttacaggagtccaaaaacgttactttgaaaaattatcaatttactgtgacagatatgctgaacaaattccagtaacctttgtgcttgggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggttgtcactcttgctgtctataccttcttctttgcgtgcctgattggacgccagtttttggatcccaccaaaggctacgcagggcatgacttggatctttacattcccatcttcaccctcctacaattcttcttctatgcaggatggcttaaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggaaacagatgcctaagaatgagtggaagatggaagatataaaaatcccactccctcagcctcaattccagtgtgctaagagtgatcctggtggttaaaggtacaacactcgaatctttcaaaacaacttggctcctaaacacaagccaacaatctcatctgctgctcaactgaaaaacattctccactttttagcatccaggcatgtggagttcctaagaaatgcactttatta

SEQ ID NO: 2192 - DNA, 2878 bp, Homo sapiens
  ENST00000488961
cagagagggctgactcagagtctgcacatggggtctgcttccaagttcttccaactgggcatatgcctccgccactctctgactgtcctttgcctgtgccaaggtttctgggaagaacaggaagttcagggatggcggaaaatgtttggcagattccctgagtccaaagccggagcacctgctcctgcctgagggcagagaggactggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggctgtctgggtccgactttcctgacgaggagtggctgtgggattatgagaagcatggccatcggcattccatgataagaagagtcaagcggttcctgagtgcccacgaacacccctccagccccagaagaagaagctacaggaggcagacaagtgacagctccatgttcttaccccgagatgacctcagcccagccagggacctactggatgtgccctcaagaaacccccccagggcctcacccacctggaagaaatcctgcttcccagaaggaagccccacgctgcacttcagcatgggagagctgtccaccatcagggagaccagccagacaagcactttacagagcctgaccccacagtccagtgtgagaacttcccccatcaaaatgccactggtacctgaggtattgatcacagcagccgaagcaccagtgcccacatcagggggctaccaccatgattccgctacctccatcttgagctctgagtttacaggggttcagccaagcaagactgagcagcagcagggccccatgggatccatcctgtctccctcagagaaggagacacctcctggaggccccagtccccagacagtttcagccagcgctgaggaaaatatattcaactgtgaagaagaccctggtgatacctttctaaaaaggtggagtcttccgggattcctggggtccagccacacttccctgggaaacctaagtccagaccccatgagctctcagccagctcttttaattgacacagaaacatcctcagagatcagtgggatcaacattgtggctggctctcgagtctcttctgatatgctgtatttaatggaaaacctggacaccaaggaaacagatatcatagagctgaacaaggaaactgaggaatcacccaaatgagtgccaccaagttctaggacctggttctagcctagattcttacctccccaaaagcagcatattaggcccaggacatacctgaaggctggtcgactttttaaaaaacatgatcacactgtataagctacttagaactttgaagggcattatgatcctgactttttgagagctgcgaaaaatcaaacgcattcacgtcatccaacacaacatggctttcatcagaagttacacagaccacagtgatttagccaaataagtcttaaccaaaaaaaggaatctgaaaaacatacatgacttataaattcatagattattagttgtggaaagagtctcatagatcatagtccaatcccctagacccaaaggcccagacacgcagggttctctatttctcttcttttttctctttctttttttctttagccataaagaaaggagatggatcacctaatgcctgaaagatcccctccttcctaacgtttttgtttgaggctttctaaccatctcattcctacttttataactattattgttattatcacttcctgattcttaagcttcatcagcaccagaacacttaattctcttcaatttccttttttacttttctctcttttccttttattctgtcatcctttttttcccttcccttctccctggttgtgctgcttttctagtaatctgtcccatttttcaggttataatatttcctcttgccaaatctgttgcttatgtcttgccatgaatttcaaaatataagacattggcaaagcctcctacagaatcatcaaaggtgtcaacaaatccagcctgatacccttccagtctcacttccagtggaaggcatataggagtgatggttccccccgtgcccttgcagccattgacatttctttctgcttccactatttggtgttgggcactggagaaaaacgaagccaagagaatatgaaatttgcatagccaaatgctatggaaccaaagaataagatgactcacatctgtttaacttgaactcttatgcaaaaatcctaatcgtgtcgcaacacgggaccagttactgtgtctatcgggtcatttgggaatgggcaggatactggagctgggaggctaatggggtccagagctgcataatggggatcggatgttggtactcctcccagggagctctcaggacagctgtttgtcgtgggctcccaagtgcctaggccatgccttacgactgctgcacttaccatttgtcatatgatggcacttgactacatatggctttagaaataaaataaccctcaaaacta

SEQ ID NO: 2193 - DNA, 3532 bp, Homo sapiens
  ENST00000330891
ataaacaggcctctacaagtggaaaaacatttaacccctgttcttgtcacactctgggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagaaaaaactatccaagatgactgtcacttactccagtaaagtagcaaatgcaactttttttggatttcataggttactcctcaagtggagaggcagcatctacaaactactgtacagggaatttattgtttttgctgttctttatacagcaataagtttggtatacagattgttacttacaggagtccaaaaacgttactttgaaaaattatcaatttactgtgacagatatgctgaacaaattccagtaacctttgtgcttgggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggttgtcactcttgctgtctataccttcttctttgcgtgcctgattggacgccagtttttggatcccaccaaaggctacgcagggcatgacttggatctttacattcccatcttcaccctcctacaattcttcttctatgcaggatggcttaaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggctgtctgggtccgactttcctgacgaggagtggctgtgggattatgagaagcatggccatcggcattccatgataagaagagtcaagcggttcctgagtgcccacgaacacccctccagccccagaagaagaagctacaggaggcagacaagtgacagctccatgttcttaccccgagatgacctcagcccagccagggacctactggatgtgccctcaagaaacccccccagggcctcacccacctggaagaaatcctgcttcccagaaggaagccccacgctgcacttcagcatgggagagctgtccaccatcagggagaccagccagacaagcactttacagagcctgaccccacagtccagtgtgagaacttcccccatcaaaatgccactggtacctgaggtattgatcacagcagccgaagcaccagtgcccacatcagggggctaccaccatgattccgctacctccatcttgagctctgagtttacaggggttcagccaagcaagactgagcagcagcagggccccatgggatccatcctgtctccctcagagaaggagacacctcctggaggccccagtccccagacagtttcagccagcgctgaggaaaatatattcaactgtgaagaagaccctggtgatacctttctaaaaaggtggagtcttccgggattcctggggtccagccacacttccctgggaaacctaagtccagaccccatgagctctcagccagctcttttaattgacacagaaacatcctcagagatcagtgggatcaacattgtggctggctctcgagtctcttctgatatgctgtatttaatggaaaacctggacaccaaggaaacagatatcatagagctgaacaaggaaactgaggaatcacccaaatgagtgccaccaagttctaggacctggttctagcctagattcttacctccccaaaagcagcatattaggcccaggacatacctgaaggctggtcgactttttaaaaaacatgatcacactgtataagctacttagaactttgaagggcattatgatcctgactttttgagagctgcgaaaaatcaaacgcattcacgtcatccaacacaacatggctttcatcagaagttacacagaccacagtgatttagccaaataagtcttaaccaaaaaaaggaatctgaaaaacatacatgacttataaattcatagattattagttgtggaaagagtctcatagatcatagtccaatcccctagacccaaaggcccagacacgcagggttctctatttctcttcttttttctctttctttttttctttagccataaagaaaggagatggatcacctaatgcctgaaagatcccctccttcctaacgtttttgtttgaggctttctaaccatctcattcctacttttataactattattgttattatcacttcctgattcttaagcttcatcagcaccagaacacttaattctcttcaatttccttttttacttttctctcttttccttttattctgtcatcctttttttcccttcccttctccctggttgtgctgcttttctagtaatctgtcccatttttcaggttataatatttcctcttgccaaatctgttgcttatgtcttgccatgaatttcaaaatataagacattggcaaagcctcctacagaatcatcaaaggtgtcaacaaatccagcctgatacccttccagtctcacttccagtggaaggcatataggagtgatggttccccccgtgcccttgcagccattgacatttctttctgcttccactatttggtgttgggcactggagaaaaacgaagccaagagaatatgaaatttgcatagccaaatgctatggaaccaaagaataagatgactcacatctgtttaacttgaactcttatgcaaaaatcctaatcgtgtcgcaacacgggaccagttactgtgtctatcgggtcatttgggaatgggcaggatactggagctgggaggctaatggggtccagagctgcataatggggatcggatgttggtactcctcccagggagctctcaggacagctgtttgtcgtgggctcccaagtgcctaggccatgccttacgactgctgcacttaccatttgtcatatgatggcacttgactacatatggctttagaaataaaataaccctcaaaacta

SEQ ID NO: 2194 - DNA, 2929 bp, Homo sapiens
  ENST00000553096
ccgacctgaaggcacctcttcgggggagcccgaaatttgaagattctctttcctgtcggagactacaaaccaaataaatagggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggttgtcactcttgctgtctataccttcttctttgcgtgcctgattggacgccagtttttggatcccaccaaaggctacgcagggcatgacttggatctttacattcccatcttcaccctcctacaattcttcttctatgcaggatggcttaaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggctgtctgggtccgactttcctgacgaggagtggctgtgggattatgagaagcatggccatcggcattccatgataagaagagtcaagcggttcctgagtgcccacgaacacccctccagccccagaagaagaagctacaggaggcagacaagtgacagctccatgttcttaccccgagatgacctcagcccagccagggacctactggatgtgccctcaagaaacccccccagggcctcacccacctggaagaaatcctgcttcccagaaggaagccccacgctgcacttcagcatgggagagctgtccaccatcagggagaccagccagacaagcactttacagagcctgaccccacagtccagtgtgagaacttcccccatcaaaatgccactggtacctgaggtattgatcacagcagccgaagcaccagtgcccacatcagggggctaccaccatgattccgctacctccatcttgagctctgagtttacaggggttcagccaagcaagactgagcagcagcagggccccatgggatccatcctgtctccctcagagaaggagacacctcctggaggccccagtccccagacagtttcagccagcgctgaggaaaatatattcaactgtgaagaagaccctggtgatacctttctaaaaaggtggagtcttccgggattcctggggtccagccacacttccctgggaaacctaagtccagaccccatgagctctcagccagctcttttaattgacacagaaacatcctcagagatcagtgggatcaacattgtggctggctctcgagtctcttctgatatgctgtatttaatggaaaacctggacaccaaggaaacagatatcatagagctgaacaaggaaactgaggaatcacccaaatgagtgccaccaagttctaggacctggttctagcctagattcttacctccccaaaagcagcatattaggcccaggacatacctgaaggctggtcgactttttaaaaaacatgatcacactgtataagctacttagaactttgaagggcattatgatcctgactttttgagagctgcgaaaaatcaaacgcattcacgtcatccaacacaacatggctttcatcagaagttacacagaccacagtgatttagccaaataagtcttaaccaaaaaaaggaatctgaaaaacatacatgacttataaattcatagattattagttgtggaaagagtctcatagatcatagtccaatcccctagacccaaaggcccagacacgcagggttctctatttctcttcttttttctctttctttttttctttagccataaagaaaggagatggatcacctaatgcctgaaagatcccctccttcctaacgtttttgtttgaggctttctaaccatctcattcctacttttataactattattgttattatcacttcctgattcttaagcttcatcagcaccagaacacttaattctcttcaatttccttttttacttttctctcttttccttttattctgtcatcctttttttcccttcccttctccctggttgtgctgcttttctagtaatctgtcccatttttcaggttataatatttcctcttgccaaatctgttgcttatgtcttgccatgaatttcaaaatataagacattggcaaagcctcctacagaatcatcaaaggtgtcaacaaatccagcctgatacccttccagtctcacttccagtggaaggcatataggagtgatggttccccccgtgcccttgcagccattgacatttctttctgcttccactatttggtgttgggcactggagaaaaacgaagccaagagaatatgaaatttgcatagccaaatgctatggaaccaaagaataagatgactcacatctgtttaacttgaactcttatgcaaaaatcctaatcgtgtcgcaacacgggaccagttactgtgtctatcgggtcatttgggaatgg

SEQ ID NO: 2195 - DNA, 1692 bp, Homo sapiens
  ENST00000476098
agtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggagatctcgcttcaaccctgttccctttgccgaatgtctcctaatccccatcagtgatggtttgtggcacttctcttccaaaggggcctctgaggctgaaaacctttccagacccaaagaaaaggaagactgaaagtggaatttcagtagttccagcaaataatgagaacgatttaggagccaggagatttgccttgttgcccgcaaagcacatcttagagaaggttgcctactccaggctagatttgcttctgcttctagctagccttctaagaccagacccacccacccagggctccttccaggccagagagctcatccctgccctcagtgtattctcagtttccatggataggaatctcttgttgtatgcatgtctcagccttcatgataccttctgcaggggcagagcttcatggacatccagcaatcatctcaattttcagaattaataagagctgttcttctgtgagtttgattttagataattaaatatgctttatccttttcctcactctcaccattgattaatgcaaagtacttgacgatttaacttgaaaagaaaagagaccagcaatactgatagaatcagagcatcattgtgataactctatttagactgcaaatgctccaaacactctatttcttatgtccattgagttgttgttaccccatggttaagataattttttgaaggtctcaaaatttttatcctgacctacttatttatcctaatcatcataattctgcagattactacataaatgttcatgttctttagcaaatattaaaacacatttctcttgtttctaaatacagaaacagaaatagggattgacaagatctcagagaaaattccttccccaaaagatcattgggaagattagatgagattgtaaa

SEQ ID NO: 2196 - DNA, 720 bp, Homo sapiens
  ENST00000552295
aggcacaaatgacattttttttctggaaggcaaaatcagaagatatggataataatatatttttgtcctccaacctctaaaaaggctaaaattcagctaaaagcatcagtgtcaccaacgtgtctgctgtaagaaactgctttataatttcctgttattctacagggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggtagcagagcagcttatcaacccttttggagaagatgatgatgattttgaaactaactggtgcattgacagaaatttgcaggtctctc

SEQ ID NO: 2197 - DNA, 572 bp, Homo sapiens
  ENST00000548658
aaagaaaatctgactgtgcacgagcgaagggtgacaccgggcgtgcagcaccgacctgaaggcacctcttcgggggagcccgaaatttgaagattctctttcctgtcggagactacaaaccaaataaatagaaaaaactatccaagatgactgtcacttactccagtaaagtagcaaatgcaactttttttggatttcataggttactcctcaagtggagaggcagcatctacaaactactgtacagggaatttattgtttttgctgttctttatacagcaataagtttggtatacagattgttacttacaggagtccaaaaacgttactttgaaaaattatcaatttactgtgacagatatgctgaacaaattccagtaacctttgtgcttggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttgg

SEQ ID NO: 2198 - DNA, 1876 bp, Homo sapiens
  ENST00000266661
atcagcagctgttgcttctgtttgttcccagctataactgtcatcagtggctaaactggcataaacaggcctctacaagtggaaaaacatttaacccctgttcttgtcacactctgggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcagaaagaactggcatgaaacccattctgccttcaagttttgagatgcagagcttttagttcctctgctaatagagcctcgtttgaatactctgcttgaaaggcaaaagacatctgcctcaacttcaatcaaggaaaaatagagcaactgtacagcaggcagaatctctatgatgactggaattttgtctatcaatggatgtaattaatcctttggctcgagggcaataaaattttgtcttaaagtagcagatcctgctccatcaaaccacaactcaattgggagtaaatgcaaacatgtatctatattgagagatagattttactctgattagaaagatgaaggagggatttggggataaacaatatgaaaattgctgagcagagctgagccagccagaagaaaaagcgatagcaagagaaactgtaggcagatgcaacggcaggataaaatagctatgccaggggtgtgatggggcctgaggagagcatggcatggagacagacacgtgcagggaaccaagtggtgggaggacaagcccactcagagtgttgccgaactgtagcaaatcagtaactataattagcacagcctcagcaatgacaataatgatcatattctgaaaaaaatattggtctctgcttaaaatggcttgaagtcctgatgagggtgacattccatttcataacaaatacttttggaatggacttgaccaacaacctagagattttctttcagttgaccgactttgatttccaaaggtggagttacttttgtgaacccccaaaatctgagacaggtctcagttaatttagaaagtttattttgccaaggttgaggatgtgcacccgtgacacagcctcaggtggtcctgatgacgtgtgcccaaagcggtcagaacagtttggttttatgcattgtaggaagacatgagacatcgatcaacatatgtaagataaacattggttcagtctggaaaagccagagatgactcaaagtggggagggggcttccgggtcataggtaggtaagagacaaatggttgcattcttctgggtttctgattagtctctccaaaggaggcaatcagatatgcatttatctcagtgaatggagcaatgactttaatagaatgggaggcatgtatgccgtaagcagttcccaacttgacttttccctttagcttagtgattttggggacccaagatattttcctttcacactttggataagtaagatgtgtgaccctgcaaggaataacaaaaattattctgcttatatattcttagaggatacattaatgtctcagtgattgtcattcatctttcacagcacccagcaaaatactcaataaatttgtgctaaaaacaaaa

SEQ ID NO: 2199 - DNA, 386 bp, Homo sapiens
  ENST00000529843
cctccgccactctctgactgtcctttgcctgtgccaaggtttctgggaagaacaggaagttcagggatggcggaaaatgtttggcagattccctgagtccaaagccggagcacctgctcctgcctgagggcagagaggactgaaagaactggcatgaaacccattctgccttcaagttttgagatgcagagcttttagttcctctgctaatagagcctcgtttgaatactctgcttgaaaggcaaaagacatctgcctcaacttcaatcaaggaaaaatagagcaactgtacagcaggcagaatctctatgatgactggaattttgtctatcaatggatgtaattaatcctttggctcgagggcaataaaattttgtcttaaagta

SEQ ID NO: 2200 - DNA, 721 bp, Homo sapiens
  ENST00000551160
gaaaaacatttaacccctgttcttgtcacactctgggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagattgttacttacaggagtccaaaaacgttactttgaaaaattatcaatttactgtgacagatatgctgaacaaattccagtaacctttgtgcttgggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcagaaagaactggcatgaaacccattctgccttcaagttttgagatgcagagcttttagttcctctgctaatagagcctcgtttgaatactctgcttgaaaggcaaaagacatctgcctcaacttcaatcaaggaaaaatagagcaactgtacagcaggcagaatctctatgatgactggaattttgtctatcaatggatgtaa

SEQ ID NO: 2201 - DNA, 670 bp, Homo sapiens
  ENST00000533674
agagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagattgttacttacaggagtccaaaaacgttactttgaaaaattatcaatttactgtgacagatatgctgaacaaattccagtaacctttgtgcttgggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcagagtctcactatgttgcctatgctggtcttgaactcctggcctcaagcaatcttcccaccatagcctcccaaagggctgggatttctggtgtgagccaccacacctggcctgccctggaatcttaatgtaaagattcttgactgtcttctatgactacagggagcctgatgagactccactggaattttcagtgacacttat

SEQ ID NO: 2202 - DNA, 2402 bp, Homo sapiens
  ENST00000331595
cctgcccagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtggctccgtg

SEQ ID NO: 2203 - DNA, 2225 bp, Homo sapiens
  ENST00000472615
tctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 2204 - DNA, 2278 bp, Homo sapiens
  ENST00000480756
tctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 2205 - DNA, 846 bp, Homo sapiens
  ENST00000431891
ctgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgact

SEQ ID NO: 2206 - DNA, 420 bp, Homo sapiens
  ENST00000492658
gtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagagctgcccctgctctcccaccacagccacccagaggcaccccatgaagcttttttctcgttcactcccaaacccaagtgtccaaggctccagtcctaggagaacagtccctgggtcagcagccaggag

SEQ ID NO: 2207 - DNA, 3262 bp, Homo sapiens
  ENST00000321870
aaaagactcccccgtctgtggcggcggctgtttgatgggtccggaaatctcttgaaggtgaatccaagcaagataaacggtgcggagaggaggcgcggggctgggctcagagcggcggcggcggcggctccactccctccgcgcccaccctcccaccatgcggggccgcggcccatggtgagccccagcagccagcaccatcggctggagacgaagaagaagaagaagaggaggcggcgagcgcgggggaaggcgaaaaagaaaaagaaagaaggggagagggctcccggcagcaccaggaccgacgcgcgcaccagctccggagcccagctcgcgcgcgtctgtggggccgcctgactccggggccgaggcggcggcggcggcagcgggcgcggcggcccgggctgcgcgccggcgcgggaccatggagcgcgggatgcacctcggtgcagcggccgccggcgaggacgacctcttcctgcacaagagcctgagcgcctccacctccaagcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgccgccgcctggaggaggcggcggcggcagcgcgggaagtggcggcggcggcggcggcggggtgggtgtccccgggctgctagtaggttcagccggcgttgggggcgaccctagcctaagcagcctgccggccggggccgccctttgcctcaagtacggcgaaagcgcgagccggggctcggtggccgagagcagcggcggcgagcagagccccgacgacgacagcgacggtcgctgcgagctcgtgctgcgggccggagtagccgacccgcgggcctccccgggagcgggaggtggtggcgcgaaggcagccgagggctgctccaatgcccacctccacggcggcgccagcgtccccccggggggcctgggcggcggcggcggcgggggtagcagcagcggtagcagtggcggcggtggcggtagcggtagcggcagcggcggcagcagcagcagcagcagcagcagcagcaagaaatccaaagagcaaaaggcgctgcggcttaacatcaatgcccgagagcgccggcggatgcacgacctgaacgacgcgctggacgagctgcgcgcggtgatcccctacgcgcacagcccctcggtgcgaaagctctccaagatcgccacgctgctgctcgccaagaactacatcctcatgcaggcgcaggccctggaggagatgcggcgcctagtcgcctacctcaaccagggccaggccatctcggctgcctccctgcccagctcggcggctgcagcggcagcagctgctgccctgcacccggcgctcggcgcctacgagcaggcagccggctacccgttcagcgccggactgcccccggctgcctcctgcccggagaagtgcgccctgtttaacagcgtctcctccagcctctgcaaacagtgcacggagaagccttaaacacacccccgaaaaacacaagaccgacccaaaatctagaggaaagcgaaaagctgctccccaccccctttattttggtcctctcgtagttgtgaaacacttgcagagcaaacaaagcagaggcaagaactgaggagaagtatcagagacaaacgggacttttagccttgacatccccagaatctcggtctttggggtggggagggagggaggagggaggtggagttgggatggagtatggatgtcttttttttctcagaaaagtggcaactttggtggcagcctagaccgcgaggaagtggaatcttccttaaaggtgaaacataagttgagaagtagtgcttggttattaagcctggagagtgtttgaatggcaaaatactaatcctactaataattgtggatttggctagtgctgagggggagaggaggggttaggggttgggtagcatgagagatggaatattcattcagacaaatcagaaagggcacttgaaaataaattttgattctgagccaggagaaaaacttgaaatgttgacttaagtgagggggaaataaaacccagagagagagagagagcgagagagagagacatgttactatgaaagacttgtattttttattgtctctgaactttaatcctgtgaaaatgctcaaagttttggcgagagtgatataaaaaaactgactgtggctgaaagaattgcatttaaaaatatttatgtgcaccttgttactttctactctgcaatgatgtattaacaattcatggtatttatttgttattcttcaatgacccttccacatcaacagtatttatcatgtgttaaagtcatgggtcttatgtgcagatttttttaatgcctctaaaattgttttatagattacttatgctgtgtgccaagtgtttaaaggtttatttgccaacaagtatgaagagaaatattgatgtatctgagctgcttaggtttatgaaaggtcacctggatattttcagttgcatcatccctgtatttaaattgagctttaataaattgcttcagtccaaaaattacaggaaaggtgtattcttaattgatgaatgaattgatctcttttttgaaaggggactcctttacattccaaaagggaaaaacatcacagcaatagttgctatacgtaagaacatgctaagcaaatatttttccaggctgtgctgtgcatttttaaaaggtctaatttaattgcttttaatatatatgtacatatatgttattttaactgtggagaattatttaagttaaaagactggtttgatttgcctatggtgtgaaatcctttgttatttttctaaaaaaataaaatttaaaaagaaagaaaactaaggaagaacaagaagctatttacccaaagtgagctttcagttttagttttgcatggctgtttgactgcctttccgccctatgaaaatcaagaaaatcttttttaaaaatggagtcctgctattttccactccttgcagataatacaaattcagtttgtcaggttggatggtgagttgggagctgtgatggatctgttggcgggttttggatgtgtaaagaatgatatatatattaaataggtcaatcagactatgacagctatgtacgaccatttgtatgtgtatctatgtcagaaagaatctttattaaaatattttgatcaaac

SEQ ID NO: 2208 - DNA, 3473 bp, Homo sapiens
  ENST00000256495
gcggccgcagccgcagacacctgggggccggggctgggggtgggggctccctagcagccgccggagcgttgtccaacacgtgagactcatgtgatgaagccgggggagggcgggcaggtcgctccttccctccccggcagtggccagacgtgcctggagtcacagggtagaacacgtagctccaacccacccactcgctcccatttaacccagcccgcagcctctccattactcctcggcttgcccccccacccccccactccgccctaaccgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaagagaaagatggtctcctgagttttttaaaatagctcacttggtgtgatatggctgactcccatgtccttctttcttggctgaagcaaaccagttaatctcagtgtaatttcattcagcttttcatgtgctttgtattcaatcagaata

SEQ ID NO: 2209 - DNA, 1366 bp, Homo sapiens
  ENST00000467610
attcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggtaagcaagtgcacccctagggaccctgcgctcagcccctcgcgcgcgctgagtttccaagaaaagttttctcgctttgaggttggcgaggggatgcagggtgtgggctcggtgcctcttctgagtgacttggaaaagaaagggcagacgatggttctgggtgctactctgctactctgctcctctgccggactgttgctgcggggctgggaggataggcttctcatctccttccccaagcgcccaccgcctccccgtgcgtcttgcaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatggg

SEQ ID NO: 2210 - DNA, 396 bp, Homo sapiens
  ENST00000460806
gcggggctgggaggataggcttctcatctccttccccaagcgcccaccgcctccccgtgcgtcttgcaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagtgctgattctggctatgctctctttaagagtttgagtgcaaatagagagcccgtgggctcaacatctgatgtaataaacattactgcaac

SEQ ID NO: 2211 - DNA, 2355 bp, Homo sapiens
  ENST00000620618
ctgcaggaagagagaccaggaagggtcgtgactgcttgcgcacggctgcaggcgttctgccgggcaagaacctcccggtgcgcccggagctgctccaagttgagagtggcgcataacatggggctgcagttgaggcttgaagggccaaggagtgccaacttaccctgatttctttgcaagtttcattaagctcttcagcatctgagaaaggattagaatgtttattcacactctccaaattccagtttatcagttcattgattcatcaacgttgattaagcacttactatgtgctgagaatacaaagggttgcagaaaaggaagaagaatcagcagagagcatttgtggccagcaaagcttaaaatatttcctaaccgatcctttgcaaaaaaagttcacccactcctgtagtcagcagctcccctactgtgcgcagtcagtgtgccatctcagactagcaaagatttgtgcttggatcatctacacttccctgaatgttgaagaagatatgctatccatgcaatccttgtcgactgcttgattaaaaagtggataaactgtcttcaggcccttggagtatggtgtctgtgtgaagaagggaatgaggcagaagtagcagtcagtggtggctgaagtaggagaaagtgcttgctaatgaaatcttgatttttctgtggcttttctgtgcaattgggtggctaagtaggaaagccattggagcttcactgtatcaattctgcctttcttgttttttggaactccaattcaccaaggctccctgccaccctatccatctataacttttcatcactttttcctcaaagtaagaagtgtgtcccagaaaatgtgcctttgtgactcagcaacatttcaaatccatctgagccttcccagcgttccaaaagaaatactgatttgaattcagctgcttaaaaaaccagtctctaagcagacagcttgaaacttccttacagcaatagtttaggctttggaggggaaattggtttgtttttaattgttttaatttttcattcaattcatttgccgcctgattatatatgatcttttgagcccaatactctgctaaattaaccttgactttctttctctctttctctctctctccttctctctttcttcctttctttctttctttttgacagagccttgctctgtcgcccaggctggaatgcagtggcacaatctcagctcactgtaaactccgcctccaaagttcaagcaattctcctgcctcagcctcctgtgtagctgggattacacacgccagccaccatgcctggctaatttttgtatttttagtaaagatggagtttcaccctcttggccaagctggtctcgaactcctgacctcaaccttggcctctcaaagtgctgggattacaagcatgagccaccatgcctggccttaccttgattttttttttttgagacagagtctcactctgttgctcaggctggagtgtagtggctcgatcttggctcactgcaacctccatctcccgggttcaagagattctcctgcctcagcctcccaagtagctgggactacaggtgtgggccaccacgcctagctaattttttatatgtttactagagacagggtttcaccatgttgggcaggctggtcttgaactcctgacctcaggtgattcacctgcctcggcctcccaaaatgctgggattacaggtgtgagccaccacacccggcccctacctttgatttttaagtcaagagggaacaagtcgaaatttctattcaggtaaactgtatacctttggacactgaatcacttttagaaccccagtaaaaatcatgtatgaatgacccacaatttcactccaacaggaaggtgtgtatatgtgcacaaaaacattagattgttcacaccggtgctattcataatagtcaaaaactggaaacaactcaaacatccatcaactgtagaatggataaataaatcatgatatattcataccatggaacataacagtgacaataaatgaaccactgctacacacaacagatatgaatttcacaaacagaatgctgagcaacagaagccaaacacagaaggatacacatttataaatccatttgtatgaagttcataaacagacaaaattagtcagtggagattattctcatagaagtctgaagggtagttgtctttagggagggggatatagtgactgaggtgggtataaggggtttctggggtttggtgatggtacaccagcatattcactctgaaaactcattgagctgtgcaataatgatttttcaaacttttatatgtgtatgataatgcttcaataaagctttgcttaaaaac

SEQ ID NO: 2212 - DNA, 2215 bp, Homo sapiens
  ENST00000615178
ctgcaggaagagagaccaggaagggtcgtgactgcttgcgcacggctgcaggcgttctgccgggcaagaacctcccggtgcgcccggagctgctccaagttgagagtggcgcataacatggggctgcagttgaggcttgaagggccaaggagtgccaacttaccctgggttgcagaaaaggaagaagaatcagcagagagcatttgtggccagcaaagcttaaaatatttcctaaccgatcctttgcaaaaaaagttcacccactcctgtagtcagcagctcccctactgtgcgcagtcagtgtgccatctcagactagcaaagatttgtgcttggatcatctacacttccctgaatgttgaagaagatatgctatccatgcaatccttgtcgactgcttgattaaaaagtggataaactgtcttcaggcccttggagtatggtgtctgtgtgaagaagggaatgaggcagaagtagcagtcagtggtggctgaagtaggagaaagtgcttgctaatgaaatcttgatttttctgtggcttttctgtgcaattgggtggctaagtaggaaagccattggagcttcactgtatcaattctgcctttcttgttttttggaactccaattcaccaaggctccctgccaccctatccatctataacttttcatcactttttcctcaaagtaagaagtgtgtcccagaaaatgtgcctttgtgactcagcaacatttcaaatccatctgagccttcccagcgttccaaaagaaatactgatttgaattcagctgcttaaaaaaccagtctctaagcagacagcttgaaacttccttacagcaatagtttaggctttggaggggaaattggtttgtttttaattgttttaatttttcattcaattcatttgccgcctgattatatatgatcttttgagcccaatactctgctaaattaaccttgactttctttctctctttctctctctctccttctctctttcttcctttctttctttctttttgacagagccttgctctgtcgcccaggctggaatgcagtggcacaatctcagctcactgtaaactccgcctccaaagttcaagcaattctcctgcctcagcctcctgtgtagctgggattacacacgccagccaccatgcctggctaatttttgtatttttagtaaagatggagtttcaccctcttggccaagctggtctcgaactcctgacctcaaccttggcctctcaaagtgctgggattacaagcatgagccaccatgcctggccttaccttgattttttttttttgagacagagtctcactctgttgctcaggctggagtgtagtggctcgatcttggctcactgcaacctccatctcccgggttcaagagattctcctgcctcagcctcccaagtagctgggactacaggtgtgggccaccacgcctagctaattttttatatgtttactagagacagggtttcaccatgttgggcaggctggtcttgaactcctgacctcaggtgattcacctgcctcggcctcccaaaatgctgggattacaggtgtgagccaccacacccggcccctacctttgatttttaagtcaagagggaacaagtcgaaatttctattcaggtaaactgtatacctttggacactgaatcacttttagaaccccagtaaaaatcatgtatgaatgacccacaatttcactccaacaggaaggtgtgtatatgtgcacaaaaacattagattgttcacaccggtgctattcataatagtcaaaaactggaaacaactcaaacatccatcaactgtagaatggataaataaatcatgatatattcataccatggaacataacagtgacaataaatgaaccactgctacacacaacagatatgaatttcacaaacagaatgctgagcaacagaagccaaacacagaaggatacacatttataaatccatttgtatgaagttcataaacagacaaaattagtcagtggagattattctcatagaagtctgaagggtagttgtctttagggagggggatatagtgactgaggtgggtataaggggtttctggggtttggtgatggtacaccagcatattcactctgaaaactcattgagctgtgcaataatgatttttcaaacttttatatgtgtatgataatgcttcaataaagctttgcttaaaaac

SEQ ID NO: 2213 - DNA, 993 bp, Homo sapiens
  ENST00000615017
agtgctgtgtatgcagccatatagtgaatgccttcatttgcaccctgaactctgaatagtcacttttaaaacatccatctgtcatccatctagtgaggtcaggagagtggctgcttaacttctgggggttgcagaaaaggaagaagaatcagcagagagcatttgtggccagcaaagcttaaaatatttcctaaccgatcctttgcaaaaaaagttcacccactcctgtagtcagcagctcccctactgtgcgcagtcagtgtgccatctcagactagcaaagttgtccagagaggaaagacaggccaaaatagttcagtatgctgtcttactgggaggacaacagcttaagccacaaagccctgagtttgaccctagaactctgtggctactggtgactcatcttgaaaattatcagattgaatcttctctaccggtttgataacaactgatgagtggaaaaagaacgccaatcaaatgtgcatgcttaataagcagcctccttattcccctctgcagatttgtgcttggatcatctacacttccctgaatgttgaagaagatatgctatccatgcaatccttgtcgactgcttgattaaaaagtggataaactgtcttcaggcccttggagtatggtgtctgtgtgaagaagggaatgaggcagaagtagcagtcagtggtggctgaagtaggagaaagtgcttgctaatgaaatcttgatttttctgtggcttttctgtgcaattgggtggctaagtaggaaagccattggagcttcactgtatcaattctgcctttcttgttttttggaactccaattcaccaaggctccctgccaccctatccatctataacttttcatcactttttcctcaaagtaagaagtgtgtcccagaaaatgtgcctttgtgactcagcaacatttcaaatccatctgagccttcccagcgttccaaaagaaatactgatttgaattcagctgcttaaaaaa

SEQ ID NO: 2214 - DNA, 557 bp, Homo sapiens
  ENST00000441386
gtcgtgactgcttgcgcacggctgcaggcgttctgccgggcaagaacctcccggtgcgcccggagctgctccaagttgagagtggcgcataacatggggctgcagttgaggcttgaagggccaaggagtgccaacttaccctgggttgcagaaaaggaagaagaatcagcagagagcatttgtggccagcaaagcttaaaatatttcctaaccgatcctttgcaaaaaaagttcacccactcctgtagtcagcagctcccctactgtgcgcagtcagtgtgccatctcagactagcaaagttgtccagagaggaaagacaggccaaaatagttcagtatgctgtcttactgggaggacaacagcttaagccacaaagccctgagtttgaccctagaactctgtggctactggtgactcatcttgaaaattatcagattgaatcttctctaccggtttgataacaactgatgagtggaaaaagaacgccaatcaaatgtgcatgcttaataagcagcctccttattcccctctgcagatttgtgcttggatcatctac

SEQ ID NO: 2215 - DNA, 1962 bp, Homo sapiens
  ENST00000551848
ccccgagactgcatcattccgcaccggctgctgcagggccagagggagcaggtggagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggtgagttgcctgtcacctctccctttcctggccctcactccccccacccgcaaggcccactcatcatgatcaagaagtcataaaggaggtgattgaaaggactgttttttcttctagggccctttgttggtaagagaagattgaaagagtccattgtttcctcccccaagagaaaaattgcctaagaaatgaatatataagctggaatttgggaggcaatggctgtttggcctgcgggggagggagattagtaagagtcatcaagtctcagcactctaagacgacattcaagtgggttggaatgtataaatcaaacttctcaaaaccgctgttatctcaaacccaggtttcagcgacaatttcgtagtccacaaaagtgatgaggtttgtgcctgaggacccacaatttcaggatttagactgtgtggcacctcagctttcctctggatgtaaccactccttggtgagagagggaactcctcaccaatcccatttgacaaaggctaggcaatcttcattctgcttggctttagtcattcttgtcattgggctgcagaagaaaaacaactttgctgggtgatcccactgccttgatttcacctcggagcgaggctgggccatgtccaagtcttatgaggtcaccctgactagaaaaaattgaactcacctacaaatagtctgaaagagtggtgtatatcaaatacgtgggtagtgttgcatttcaaatgaggctcttctggttgaaatgatatatttataaaaccagaatatcaaaaatgggtgatgtataatgtctctttagttttttggtatttggcctcttttaaagcctgtcggatgtatgggagaaaacaatgaacgtgctttgatttcctatcagtcactcttaagaacatacatattgtttaagtaactcggtcttttttatctgattcttgaggcactatgggtagcaaataaccacttacaaatttaaatgtaatatacactccttttctgtgtgtcaagtccttatttttaggtgcatattgacatttaaatgttaattattgtttggcatataatatcaaaaatctattatttattttatgctgttacagttaaaagatgtgatttatgacatactgaatcaacttgccttccaatttagtgtgtaatatggtaagcatttatacttttagatatgtcttatttttatttggatgcctgtctaccaaaaaataaatgtactacctatgattaaaaatcccaa

SEQ ID NO: 2216 - DNA, 1328 bp, Homo sapiens
  ENST00000550207
ggtggagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagagggccctttgttggtaagagaagattgaaagagtccattgtttcctcccccaagagaaaaattgcctaagaaatgaatatataagctggaatttgggaggcaatggctgtttggcctgcgggggagggagattagtaagagtcatcaagtctcagcactctaagacgacattcaagtgggttggaatgtataaatcaaacttctcaaaaccgctgttatctcaaacccaggtttcagcgacaatttcgtagtccacaaaagtgatgaggtttgtgcctgaggacccacaatttcaggatttagactgtgtggcacctcagctttcctctggatgtaaccactccttggtgagagagggaactcctcaccaatcccatttgacaaaggctaggcaatcttcattctgcttggctttagtcattcttgtcattgggctgcagaagaaaaacaactttgctgggtgatcccactgccttgatttcacctcggagcgaggctgggccatgtccaagtcttatgaggtcaccctgactagaaaaaattgaactcacctacaaatagtctgaaagagtggtgtatatcaaatacgtgggtagtgttgcatttcaaatgaggctcttctggttgaaatgatatatttataaaaccagaatatcaaaaatgggtgat

SEQ ID NO: 2217 - DNA, 8811 bp, Homo sapiens
  ENST00000548411
ctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaaattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaagaaaaaagaaacagaaaacgtgtctcagatggctggctttacctcgatagcataagagagacctaagacatgtaaaatacgtatattgcagtatcatctttcctcacactccaaattcagctagggaagttgattccaatatgtttgtcattgatatttattttgtactttatttgctacatgatttatgtctatacaaataatttctctgaggtgaatttaattcatttattttcaaataagcataatttgctcaattaagtatgagtttgaatttagtttgaaatctggaattggccagactgtggtcatttttcttgcacaaaatgataaatgaggtgcatcagaatgttaacaataactgtattttgctgctacgctggtattgtttaggcacttactttctaatcagtagctcattaactgctgggttttgtttttgtatttttaactagagttcttcactggacattactaagtaaatctaagaaagagactaagttatgatttattgacttattcaagttttgatggcatctttacttttattttttcattgcagttgagtagatgtactggtgctgctcctttgtatgtgtgtatgtgtgtgataacgttaaagaaggctcaataacttgaagggaaaaaaatggtgtgtttatttaatgaccagaattttttttacttctcccaaaatcagggtcctactgagtctttcctgataaaaggtatcaagtacaaatgggaaaatatatacatatatagatgtaagatagcctttaattaattaatttacccagagagtgttcaaagtttgattaaaattgtatgttttgttgttgttagtttttttcataacgaatcttccttgccaaaaaaacaatagataataaaccttagctcattgtctacttttgacaaacactcaggtgcctacaaacattctattatcttgagataatacatgttcctggttaatttacagattctgctgggtaacttttatgacttgatttaaggcagtggattttcatagcaaaatttattttgcacataatctgacaaacaaggaaaacagctaactgagctgaaaggtctaacactctcgggctccttaaccatcaagtgctgcccacacaattgctcctagccctgattccttgtctttgtcaggtagccttaacttatttaaaaccataagggtttgaccttttcatataaagacatctgtaacttctcttcaaaacaaaaatgaccctcactgttaacacaaaggacagttaccagtgtagggcactgagaaaggagatccaggagccactcagcttattgagcggacatgggtggcacagaaatggagtggtccatcagagaccaaatggtaagtcgtaaagcacattgcaggagctttcgttagtcatacgcctattaagtagtggtcgctattaccaaagcaaccaggacgttttgtgttctttatatgagtgctattttccacagtgtcatttattatgcaacgtggagtaaagagttgaaatcttcaccaaaataagggttcaggttaaagtacagaaacagaaacaaaacgattcgacatgaagttcccaaccatagcagcctaaccttctgctcttttctacctgcatggccttgctgttcctaaacattgtcttcatttcactggcgttgtatctgcctagtaccagtattagtgagactgtggattttatcagagttcaatgaaagaaagcttacccctgccctcactttgtgttttttatttttccccctttctcaagcaccacgtatttggacctgagaagtggcatagctgctaagttgacttttaataaaaaactgtttgtgcctgagggaaatatatgcctttttaaaaagtacctcagaacatgttcgtagatcgtctcatcggttttgtttggtgggactgggagttcagcaggaagtattgtctgtgtgtgatgacggggcagtattgccagtcggcaatgttgtatttgcattctttatccctaactctgaatctaggactccatgaaaagccgggtcacccacaaaacatttcttccaatacaaagtgtattattacgtctattataaactagtttcatttcagttatttatcttcatagagtgggaaagtctttttctgaaatactaattctatgaaaataataattttagtgaatctttgccaagaagttatagaaacttggaaataaatttctcattttcagcacaaaattaagtgatagtccctaagcagtaagagagaataccatgtatttacactgtggcatcatttagtatagtttacactgagccatatttatttataggcatttaaagtgaatcagtatgtgtagtgttgataaaaatcagtatctgtaaagataacatcaggaattcaaaaggaaattgaaaaggggcagaactagtgagaaccaaaaagaatgaactccagtaagactaattgaagacatacttggagaggaaaaataaacagcagaaatgcactaaaaaatactggctaattattgcaaacagagtgagcaaagattaatgctaactagtaaaagtagttagcaaagtaaacaggtagttttttaaaagtaagcacaattacaatattgaatagtatggagaaatgcttttctcctgaggattttccttaatcaaaaaataagaagaagcaataaattgtctttggcctgagtgctgagtggcataaataaaggagcttggcttaatctttctggtccacacataatccattagatcccattcatatatccaactctggattctaataaaataatttggagaactttgagaaaaaggaaaactgttaaataagaaaagacctatttagaaattatactttagtctaacgaagaggaggtacaatagtagtcttcaagaaaagaatatttaacaaatgatagatatcagctatagatattgttactaagtctagaataaaaaaggcttcagtgtgaaggatgtatagtaactctaggaaagagatttttaacactgggaaattaacgtggaaattgataatcataaagaatatttgttttgtaaaaattgaatatcattggtggtctagtaagtattaagtggcaagataggagaatgcatttcagttctgggagctcataatcctgtgattcttttattttaagttttaaaatacattaaaattttactggttaatcataaaatattttatatttgaaaataggatggcaatctttatttttccaagatatttgttggaaaaaaatgatcgttggtattattttttctttcagctatattccatggtatctttaaaattgttcagaatataggacttttactaaaaaaattcaattgtcagagtctaaaaaaacaatgtcctcaggaatacttcagaaatagaaggtatgcaatcccttagtggggggcaaacacatttcagatttcgtctttatttaaaaggatcttcagtctacaacatttgcttttttcgtgctttggaaaatatccttgtgcagataagttcttctgtttgaaacaagcatgaaacattggtccaataacctaagaatgtggagatttcttgatattctgtattaattaaagttctctacatgtctcaaatggagatcacaaaacatgaaaaggaagaaatgaaatatcttttcttctgggatgagtgtcaattttaatgtataattgtcataatcaatcagccaaaagttacaatctgtccctcagagacattgggggaagctgatggatttccagtaaggaactgtggtgggttcaaactcaggctgccacaaatacattgatatggtaggtaggaagtaggactaaatttgaaagaaacttatgggataaagttcacaattttaaaaaggttgccctccagtttttttgtttgtttataaactagagtgatttttaagtaacccttatatttaaggctgcaaaaaatgtacaagagtatgttttcaagtaaagggaacataattcttcaaaaagctgttgaactggagttatgataggttatgacagagagcatgatcagtgctgatactgacaagtacttttttaccttaaaatcaacttctatggaactacaagatcaatctagctcccgagtgacattttccattgtctgtaataatgccctcggatgagttgtgtctaaaattaagttcatctttatttatatgcgaacttaactgccatagtccctaatgtattgcgtttgtaacctgatcgtattatgtttacagctgaaagatttcatctagacatgtctttcgtccttattattcaaagtgtaattgaaagagatatttagtattaagacatgttccccaattgagaattttccagaatattctacttaagaagaagaagagcaattaactgcctttagtgtaagggcgagagtgcatagaaatatgcaatgtaaaatgtttgcatgaattatttcacatcatgtaagctttcccatattcataagatgaacactatagaagtctcatttctctgtgatcttctgtccattaggaaagtaaggagattgttatctatatctagtctcctttccatattgaactgcatggctctaatcctcagtgtatttttatcccttctcgagttatttaaaatttgccctatttaagctgaagcctggataaactgctgagccagattattcctgtgattggagtttaattgctgtagaacacttgttgagaacacattttttactttttttctttcagaattattcctcaatcattgttctctaatgaaaacaccgagaagtaaatctggtgcttcttagtgtaaatatgtttttctttttaaaaagtcattttaaaacaaagatgagagaactataaagtaaggggaaatatcattttatttaaaaataattattcaatgatagataatggagatacagaatgactcattgggttcataggtatgatttgtgcagccagtcttagaggaaatacatcattttaacattattcccacaaaatgttaaagctcaatggtttgactatgagagtcaaacaattactatttgaaaatctcttatgacatttttataatctactctgtttttatttgcatgattatgcttatgtgatgaaccatccatgattctgatattgtatttctttccagtattaacatgtgtattgtgtggccaactctgatttgtacaccgtattattgttgtaatgattcaactgttcctacatttaattgcagtttaattattatgccttttggggttaaatgatgtgaagtgtttccacctactgataaataccatatgaaaacacgactaaaagactgatttaagaaacttgttatttttaaaaatatgaatttcaaaagaaatgttctcaaagacacatgcatttattttaaattcaaaaaattcttatgaatttattattgcttgtactttaactttttttattgtagacaatcctaagtgaataatgtctcatgggagaacacatgatatgtgcttgtatttgtgtaatctgatcatgcactcaatggttggaaaaggcactccagtgctaagaaaataaccagaagccaatatatcgattcttatatctcggtttatgttaccaactgaatatggtgtaatgcataactttttccagtaaataaactggttattttttgttcatttca

SEQ ID NO: 2218 - DNA, 3281 bp, Homo sapiens
  ENST00000281474
ccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaagtaagtggggaggcatcagtcaccgtgcccaccatagacacttacctcctgcatagtcagggcccacagacacccaacattcgggtcagcagtggcactcagaggaaaagacaattttcaccttccctttgtgatcagagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccagattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaattt

SEQ ID NO: 2219 - DNA, 3194 bp, Homo sapiens
  ENST00000395758
tttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaaacaattttcaccttccctttgtgatcagagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccagattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaagaaaaaagaaacagaaaacgtgtctcagatggctggct

SEQ ID NO: 2220 - DNA, 423 bp, Homo sapiens
  ENST00000551086
ccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagagggccctttgttgttaaaagatgtgatttatgacatactgaatcaacttgccttccaatttagtgtgtaatatggtaagcatttatacttttagatatgtcttatttttatttggatgcctgtctaccaaaaaataaatgtactacctatgattaaaaatcccaactaggaatct

SEQ ID NO: 2221 - DNA, 766 bp, Homo sapiens
  ENST00000547680
gtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcaggcacagtgccttctgatgaagtcagtaaatgcttatgaagcaccgtccatctagcactgtgctagatgctgaagattcaaagaagactaacacatggtccctgccttccagaagactcagcctcctggggatgtcaggatagaaacacaattacagttcaacgttacacatgctgtaatccaagttatgagaacaatgcagaggaagcaactaaggtttcctagaggagcggaaaagacttcacagaagcaattataccttagtttgttattaaaggataagaagttgttttccagaggaggaggaagtaattccagacagaacagtaggtagagaggctttggagtgacaaaatagaataatatattcagggaatgctcacaaaggcctatgtggctggaaataagactttttttatttagaaagtcaactttggaatgtgtggagaaagtggtgaaagcagaaatcagcaaatccagtgagttatggatacttaaaattacttaattctggaaaaactttgcacagtcaatggacaaacaaatctacaaacaaaactgaggctttggggtatttgtcacaaacaataaatgattttgtatttctgtttca

SEQ ID NO: 2222 - DNA, 1583 bp, Homo sapiens
  ENST00000552160
cagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaagtaagtggggaggcatcagtcaccgtgcccaccatagacacttacctcctgcatagtcagggcccacagacacccaacattcgggtcagcagtggcactcagaggaaaaggtatgcatgcagcgatcttcatagtacggtgcagtggccagattttagttaactgcaaaaataaatgtgctcttgttgtggaggatggaggaggggaagcaaaagaaaaaatgggagctggcatataaatggtcttgctaatgtgggtctttccagatcaaaacctttttgataattgtgtttatgtagtcctttctaaccccctgcccaatccctcctcttgattaatcgtaatataattttcaagtgtctgttaatatttttgctactctttgtatgtgtaaatatgcctctcccttacctccaacctgagaattggtagataaaggtggatattaagaatgaagctgtgttctacctgggttataattttaaaagtcattgtacctttggaaatggtgctgtttatcagcttctctttaacggggcaaggatatgaatatgttctcttagggaaacttttgtccatatgaccaaaactgatgacagactgaaaggggatgtctatatctagataaaatgggatggaatacgcacagtccttttcttgaaagcaggtttttgtgctttttcatttggcatgggaatattgcccagagaaaccacttgtaaggtttttaggggcttgattttgtgagtcctggctgttgagttacttaccctgtattttcggttaatggtaacatttttattttaggagctttcattaaagactcaaataatatattttctatttgcggttcaagctgactaactgtaataaatcttttttccagtatccagaacagtttccaaatagggttgtatcctgatgtggaaactaaaaaaaaaaaaagcaaaaagattgatttacatatttaaaaaattaaatgccagtataaataatgttgtcactggtgaggcgttaaaaggtaattaaagtaaaacttttttgtttcctatatgtatttttcttggatctcctgcaagacaattttcaccttccctttgtgatcagagccgtcccaggacttcaggggcttcctacctacagaatttattaagagttccccctgatcccacctccacagaatcatttcttctgaagggccccccttccatgagtgaattcatc

SEQ ID NO: 2223 - DNA, 543 bp, Homo sapiens
  ENST00000552226
atgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaaacaattttcaccttccctttgtgatcagagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccaggtaaacattttttccttgggtgcatgtgatgcaaatgattagttgaatagactctccccttccttccggtcactcaggctcacccagctgcagagtatacctttgatgatgtgtaaattcctataagtcaagtaaaaactt

SEQ ID NO: 2224 - DNA, 529 bp, Homo sapiens
  ENST00000614004
aaaagctgaatcaggatatttctgtgtgaatgcacattcctcactaaatctctcaggcagctgctttagtcactgttactaacaccttgctctgtcatctctttgtacacatgtctaatttatcagtttcttgtagattgtcagcagcctgctgcctccgtaccgccacagtgctcacaactagccgggaggcaagactgcccaactgtcaggtaaattcagatgtcctttcccttccacccagctgcatgtcagatccatagaccccagctcccctttccgacacctgaactgcctacgcatcattgtattttgctgtattttatttcaagtgtgggctacatagacacacattggacacctgcagtccctgcgttcccagtaggaatacaagagagctggggtttattttgctggctgccagctggtagactctacaggctgccttcagcccctttgtctgtgtaaatacttggattagtccactgtttcattcctttccaaaaaataaaagctggaattgttatga

SEQ ID NO: 2225 - DNA, 6427 bp, Homo sapiens
  ENST00000356884
gcggcggcggctgaggagggcccggcctgcgagagcctcagtgggagccggctcagccctcggccaccatgtcggcgccgtcggaggaggaggagtacgcgcggctggtgatggaggcgcagccggagtggctgcgcgccgaggtgaagcggctgtcccacgagctggccgagaccacgcgtgagaagatccaggcggccgagtacgggctggcggtgctcgaggagaagcaccagctcaagctgcagttcgaggagctcgaggtggactatgaggctatccgcagcgagatggagcagctcaaggaggcctttggacaagcacacacaaaccacaagaaggtggctgctgacggagagagccgggaggagagcctgatccaggagtcggcctccaaggagcagtactacgtgcggaaggtgctagagctgcagacggagctgaagcagttgcgcaatgtcctcaccaacacgcagtcggagaatgagcgcctggcctctgtggcccaggagctgaaggagatcaaccagaatgtggagatccagcgtggccgcctgcgggatgacatcaaggagtacaaattccgggaagctcgtctgctgcaggactactcggaactggaggaggagaacatcagcctgcagaagcaagtgtctgtgctcagacagaaccaggtggagtttgagggcctcaagcatgagatcaagcgtctggaggaggagaccgagtacctcaacagccagctggaggatgccatccgcctcaaggagatctcagagcggcagctggaggaggcgctggagaccctgaagacggagcgcgaacagaagaacagcctgcgcaaggagctgtcacactacatgagcatcaatgactccttctacaccagccacctgcatgtctcgctggatggcctcaagttcagtgacgatgctgccgagcccaacaacgatgccgaggccctggtcaatggctttgagcacggcggcctggccaagctgccactggacaacaagacctccacgcccaagaaggagggcctcgcaccgccctcccccagcctcgtctccgacctactcagtgagctcaacatctctgagatccagaagctgaagcagcagctgatgcagatggagcgggaaaaggcgggcctgctggcaacgctgcaggacacacagaagcagctggagcacacgcggggctccctgtcagaacagcaggagaaggtgacccgcctcacagagaatctgagtgccctgcggcgcctgcaggccagcaaggagcggcagacagccctggacaacgagaaggaccgtgacagccatgaggatggggactactacgaggtggacatcaacgggcctgagatcttggcctgcaagtaccatgtggctgtggctgaggctggcgagctccgcgagcagctcaaggcactgcgcagcacgcacgaggctcgtgaggcccagcacgccgaggagaagggccgctatgaggctgagggccaggcactcacggagaaggtctccctgctagagaaggccagccgccaggaccgcgagctgctggcccggctggagaaggagctaaagaaggtgagcgacgtcgccggcgagacacagggcagcctgagtgtggcccaggatgagctggtgaccttcagtgaggagctggccaatctctaccaccacgtgtgcatgtgcaacaatgagacacccaaccgtgtcatgctggactactaccgcgagggccagggcggggccggccgcaccagtcccgggggccgcaccagccccgaggcgcgtggccggcgctcacccatcctcctacccaaggggctgctggctcctgaggcgggccgagcagatggtgggacgggggacagcagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcgtaagtcacacctgtgcctgtgccagcgacagggccgagggcaccgggctggccaaccaggtgttctgcagcgagaagcacagcatttactgtgattaggggctgtggggcgccgcacgctgcagctaacatctgcttcacctcaactaacccagcagcagcgggacggcggtgctaggtcaatcttaacgtgactaatgcacagagggtaggagtctagccgaggcgccatggggcgttgcatcagcaggacacttgtgagagctttgtgtcgcttctcactcctcaaagccccctcaggagcacccagtcctcagctgctctcttaggtgggggtcagaggtggggatagagctgcacattcttgcagcagatgtgtgatgaaagcatcttctaagccctgcgcacccgtggggaaacccaagggaggagtcctggtcctgctccctcagcacccaaaaggggcagaacctgagttgagacttgcatgttcctcgcatgtgtctaatgtcagcactagaaagcagttttaggaggttccagcctgcagcataggtacgacctcagaggatggctttgcacttggcatagtttcatggaaaggagtacgttgtagtttatgcagtatctgactgcaaatcatattcaggaaagaagtgcagaatttcttccccaagcccagagaagagcagccctgagcccctgtattctgctggccagacacacatggcacagacacagctgaccataacccaggaatccagagctcggtttctcatttctgagatcaggatgcttgtatagtggcctgtgaggtgacagattggcagggcccaaggccccaggttttcatttttcatgagaaaagctttccaagtgcctggccagaccttggtccttagtgcagagcccgtccttttgtacttggggtgaccccagcagccaattatccggccttccatagggggttcagtcccaaagacatggggctttgaaaaccctagcctgaagtctgagccaccaagggcttggctgggttggacacccacaggtgtatccagagcccagcccggtgctgggaaagctttgcatagggccagggccacttgtcaggattcacaggtaggagatgtttaggtctctttatttagtgcaatctgggggatggcaacagagaaagaggaaaggtagctgtagggttctcccatttccagaggctccatccacacctgccttcccacattctgagcagaacttttctcagtacttttttcccgatcaccctgtgggaccagctggacctgaggctgcagtcttctctcctgcaggctgcttgccttgtctctcatgcggaagaggcattcgagttacctggtgagagaccgtgttgccccctcccacagctctctgccctgcgcgttcttccctttggtgccgagtatgtttcggtcccctccagactccaggacacgcccatgtatgtcccctgcgtgttcatcctgggcccagatccccctgccccagcaagactcgcagtgggatggctgctggcatgcccaccctgcatgcgctttgccctctccttgcaagcctggcacatagcttctctccatactcctaagggactttgcagacacccaagccactgggacccctgctaacacatgcaggtcttctcttctgccaactaacgtgctcgcgccctcccagcacgtggagagcttcaattgtcagataaacaggaagcgacagatgaccgctttctaacgctctcttttctcccgttttcagctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagcaca

SEQ ID NO: 2226 - DNA, 4636 bp, Homo sapiens
  ENST00000375512
gcggcggcggctgaggagggcccggcctgcgagagcctcagtgggagccggctcagccctcggccaccatgtcggcgccgtcggaggaggaggagtacgcgcggctggtgatggaggcgcagccggagtggctgcgcgccgaggtgaagcggctgtcccacgagctggccgagaccacgcgtgagaagatccaggcggccgagtacgggctggcggtgctcgaggagaagcaccagctcaagctgcagttcgaggagctcgaggtggactatgaggctatccgcagcgagatggagcagctcaaggaggcctttggacaagcacacacaaaccacaagaaggtggctgctgacggagagagccgggaggagagcctgatccaggagtcggcctccaaggagcagtactacgtgcggaaggtgctagagctgcagacggagctgaagcagttgcgcaatgtcctcaccaacacgcagtcggagaatgagcgcctggcctctgtggcccaggagctgaaggagatcaaccagaatgtggagatccagcgtggccgcctgcgggatgacatcaaggagtacaaattccgggaagctcgtctgctgcaggactactcggaactggaggaggagaacatcagcctgcagaagcaagtgtctgtgctcagacagaaccaggtggagtttgagggcctcaagcatgagatcaagcgtctggaggaggagaccgagtacctcaacagccagctggaggatgccatccgcctcaaggagatctcagagcggcagctggaggaggcgctggagaccctgaagacggagcgcgaacagaagaacagcctgcgcaaggagctgtcacactacatgagcatcaatgactccttctacaccagccacctgcatgtctcgctggatggcctcaagttcagtgacgatgctgccgagcccaacaacgatgccgaggccctggtcaatggctttgagcacggcggcctggccaagctgccactggacaacaagacctccacgcccaagaaggagggcctcgcaccgccctcccccagcctcgtctccgacctactcagtgagctcaacatctctgagatccagaagctgaagcagcagctgatgcagatggagcgggaaaaggcgggcctgctggcaacgctgcaggacacacagaagcagctggagcacacgcggggctccctgtcagaacagcaggagaaggtgacccgcctcacagagaatctgagtgccctgcggcgcctgcaggccagcaaggagcggcagacagccctggacaacgagaaggaccgtgacagccatgaggatggggactactacgaggtggacatcaacgggcctgagatcttggcctgcaagtaccatgtggctgtggctgaggctggcgagctccgcgagcagctcaaggcactgcgcagcacgcacgaggctcgtgaggcccagcacgccgaggagaagggccgctatgaggctgagggccaggcactcacggagaaggtctccctgctagagaaggccagccgccaggaccgcgagctgctggcccggctggagaaggagctaaagaaggtgagcgacgtcgccggcgagacacagggcagcctgagtgtggcccaggatgagctggtgaccttcagtgaggagctggccaatctctaccaccacgtgtgcatgtgcaacaatgagacacccaaccgtgtcatgctggactactaccgcgagggccagggcggggccggccgcaccagtcccgggggccgcaccagccccgaggcgcgtggccggcgctcacccatcctcctacccaaggggctgctggctcctgaggcgggccgagcagatggtgggacgggggacagcagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagcaca

SEQ ID NO: 2227 - DNA, 5258 bp, Homo sapiens
  ENST00000355112
aatcggaataggcaagcttccggcgggaagtgagccagggcttggcgcggcggccgtggttgcggcgcgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaataagcatgttttgctgccgctgcaagtgttgtggccgttgtttctcagaacgtctgaggcagcagctgaatcatctcagtgcaagagcttctgagcataacacgaaacccagaagccaaaggaagagccacgcgtgggcccttgtgaaactaaagcttttcgtgtaagacaacacaaacaaaatttaaagacaaatgacggggaaaagaggagaaaatatattacaaaggattagtatccatcataccaaatacccgtgaaccagtcagaaacatcccagggggcaggtggaccaaggatgtgaacaggctagtctcagaagaagaaatacacatgctcatggcccggcactgtggctcacgcctgggatcccagcactttgggaggccgaggcaggtggatcacgaggtcaggagtttgagaccagcctgcccaacatggtgaaaccccgtctctactaaaaatacaaaaattagccaggcgtggtgtacaggcacgcctgtagtcccagctactcaggaggctgaggcaagagaatcgcttgaacccaggaggcggaggttgcagtgagccgagatcgtgccactgcactccagcctgggtgacagagcaagactccgtctcaaaaaaaaaaaaaaaaaaagaaatatacatgctctgcaaatatgtgaaaaaggtcaatctccatgaataaaaatatgataaaacc

SEQ ID NO: 2228 - DNA, 3966 bp, Homo sapiens
  ENST00000560509
cgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgacca

SEQ ID NO: 2229 - DNA, 4510 bp, Homo sapiens
  ENST00000559724
ggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgggtctcactgtgttgcccaggctggtcttgaactcctggacttaagcaatcctcctgccttggcctccccaaagggctgggattacagtcatgagccaccatgcctagccaagacttttttttttttccctcaaagaaaaatattaacaacataattattttatagctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatct

SEQ ID NO: 2230 - DNA, 866 bp, Homo sapiens
  ENST00000559282
attatggctgctgttcctcaaaataatctacaggagcaactagaacgtcactcagccagaacacttaataataaattaagtctttcaaaaccaaaattttcgtaagtgttttgactggtttgctgtcacataggcactaacttaccacattgtacacatgagatatcttctctttaaactcccccattgtacagatgaggaaatgaagctgagagattcattgattttcccactttgccaattaatggtagagtatgttttagcagcaccagaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggtt

SEQ ID NO: 2231 - DNA, 577 bp, Homo sapiens
  ENST00000558599
atataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccagg

SEQ ID NO: 2232 - DNA, 533 bp, Homo sapiens
  ENST00000559426
gagtcagatttggagaaaagctgagaagggctagtttaagtctagaggttaaagtgctgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgaga

SEQ ID NO: 2233 - DNA, 2023 bp, Homo sapiens
  ENST00000560136
agtttaagtctagaggttaaagtgctgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactgattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatg

SEQ ID NO: 2234 - DNA, 747 bp, Homo sapiens
  ENST00000560559
tgactgtgtgagcaacaccccccacacctcagtagcaaaaacagagaacagtggcagcacatcgtgggctgactgcagttgattctggctctcttacatgagaatgccaagtcatacaagaaagtgcctgccatgctgagcttctctttaccttcttgggttttaatggcattgcaagttatcagtataaaaactcatattagttatactaaatagttggaccaagttaagatattaggttgttatgtagtgtgcattttaaagtaaaacaaatgatagagcttttagaagcatctattatgaaaatgttccttcaagtctgtgccttatgaatctaataagcttttgcttttatatcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaag

SEQ ID NO: 2235 - DNA, 1683 bp, Homo sapiens
  ENST00000558825
ctttgacctcagatactcagagaagtgcatggccactgccgtaatctcaggctctgcttcctcaggatgttcagttcggtggatgctcgactgataaatacagcaaatataagtcaaaccatcatcattggggataatgaagatttgaaaaaaaaaaacctaacatttattcctatagtactaaaatcttgaggatgaacattaatactcagttaattataatatagaatgccatgttgacaatgctgttaacagtaattttcttatttaatatttaaagttatatgaatctattctaaatatttctatgatatgctctatttttcccctataagtatgtcttactatagtcttcatctcttttagtggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgt

SEQ ID NO: 2236 - DNA, 1024 bp, Homo sapiens
  ENST00000560821
cagtaaagagagggcacaccagtctcagctagatgagtactggccatgggaacagtgggcaagagcagatctgctccactccacgcacatggcacaggtcccaccctcagcttcctcctgccctggctcttgcccttgctctgccctggcctatgccgctggaattggatgaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaataagcatgttttgctgccgctgcaagtgttgtggccgttgtttctcagaacgtctgaggcagcagctgaatcatctcagtgcaagagcttctgagcataacacgaaacccagaagccaaaggaagagccacgcgtgggcccttgtgaaactaaagcttttcgtgtaagacaac

SEQ ID NO: 2237 - DNA, 1784 bp, Homo sapiens
  ENST00000224337
gcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaa

SEQ ID NO: 2238 - DNA, 1715 bp, Homo sapiens
  ENST00000371176
gcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaa

SEQ ID NO: 2239 - DNA, 625 bp, Homo sapiens
  ENST00000485193
gatgaatgcagaggtggtaggatgtacctgtaacactgctgggagggagtcctggtcctcatagcacaaccacatcaacagactggcaagtgcacagatccatgacatctcagtaactaagacatgttcccgggaagacttctgatcaaatttggttcttctcagctgatgttgctgggttttgggatgaggacagacatttcactctaatcctaatatgataattttcctgatccagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggtctgatcatttttattatttattatttttattttattttattttatttatttgttttgagatgatgcagtttcactggagtgcagtggctcgatctcagctcactgca

SEQ ID NO: 2240 - DNA, 927 bp, Homo sapiens
  ENST00000467799
tgtgctcgggcaagttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatataggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaa

SEQ ID NO: 2241 - DNA, 557 bp, Homo sapiens
  ENST00000468252
acatttgtgcagtgtgcacagatgtaggtgtgagctgttggctcccttcctgaaggacctctgtgggggtcctcactgagtcctcagaatcagtgggctcaggacttgccccatggggcagggggcgggtaaggagaaggtcctttagaaatgttaaggtggagtccctaacccccatcccagctctgagcttatacactgacacttttaaaatgtgtcatcacctttgcccacaagttttccttaatagcttcaatataactacctatatgtgcttaactgaaagcaacacagtatgtgcaaatatttctgagcctgccagagaggccagcctcagtgtgagcatcagcccccggctcaggacttggggactgagtagtgtatatgtttgtgcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaa

SEQ ID NO: 2242 - DNA, 1138 bp, Homo sapiens
  ENST00000472763
gctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaaggtaagagtttgtcgccttaagcacctgaaaatttttagcagttgatcaggatgtataagagtatttggtagtaagcactaagaggctcagaaatgacagtgcccaggactttctcccctgggccacagtgtgtgcttctttggctggttgggcagacagcatcagtgacaacccatctctgtgtatcatagcccttccctgccttccccttcctcttccatgctttaatcttcccatctcacattatgaaagcacctgggtagttctcttcagctgccctcgcttcaaatggatttctcataaaacctaatacaatgtcacaagccaccatgttggccttgtaaacattgcaccaagaacagtttctgcagaggagtgaaaaaatgaaagagtgaaatatgccctgagtcctggttctttaaatttagtagtatgataagcctatgaaacatttcatccgtaaacccttcacagaacaacaaatgctatgaccaatgaattaccttaaaaagccagtgctacataagattaggcatggaaacagggtatgtttactctgaatatagtcactatggagaatatgatccagtacaagtgatacctcttcaggtaacattactcatctactactctcaactccatggtagccatattcaggtttcagtccgccatcatgtagcaaccctctcccgtactccgtacctatcaccaacagcttcaagacccacctgaattcccaagccacccattaccacaaaagaacaaatacacattccctccttaccaacccctctttaaaaaaac

SEQ ID NO: 2243 - DNA, 440 bp, Homo sapiens
  ENST00000495266
atggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagacacctgctccctttcctggaacccttccaaatagtcttgatgtcagaacatttaatctctcctggaatgcagaagtgtggcccaacaggatcttctaagcctttgcaacacaaagtttgattcccagcaagatagcatcaacctcatctggagcttgttagaaatgcagaatcttggccccaccctagaactactggatcagaatttacattttagcaagatctccaggggatctgaatgtaaatcatatttaagaaaccctgctataaaccacca

SEQ ID NO: 2244 - DNA, 1284 bp, Homo sapiens
  ENST00000427367
acttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttattttt

SEQ ID NO: 2245 - DNA, 1599 bp, Homo sapiens
  ENST00000413476
acttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttattttt

SEQ ID NO: 2246 - DNA, 2741 bp, Homo sapiens
  ENST00000389010
agccgggcagctgcagcggagccgcggagcgggcggcggggcccaggctgtgcgcttggggagcgcggaatgtgaggcttggcgggccgcagcacgctcggacgggccaggggcggcgacccctcgcggacgcccggctgcgcgccgggccggggacttgcccttgcacgctccctgcgccctccagctcgccggcgggaccatgaagaagttctctcggatgcccaagtcggagggcggcagcggcggcggagcggcgggtggcggggctggcggggccggggccggggccggctgcggctccggcggctcgtccgtgggggtccgggtgttcgcggtcggccgccaccaggtcaccctggaagagtcgctggccgaaggtggattctccacagttttcctcgtgcgtactcacggtggaatccgatgtgcattgaagcgaatgtatgtcaataacatgccagacctcaatgtttgtaaaagggaaattacaattatgaaagagctatctggtcacaaaaatattgtgggctatttggactgtgctgttaattcaattagtgataatgtatgggaagtccttatcttaatggaatattgtcgagctggacaggtagtgaatcaaatgaataagaagctacagacgggttttacagaaccagaagtgttacagatattctgtgatacctgtgaagctgttgcaaggttgcatcagtgtaagactccaataattcaccgggatctgaaggtagaaaatattttgttgaatgatggtgggaactatgtactttgtgactttggcagtgccactaataaatttcttaatcctcaaaaagatggagttaatgtagtagaagaagaaattaaaaagtatacaactctgtcatacagagcccctgaaatgatcaacctttatggagggaaacccatcaccaccaaggctgatatctgggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataagtgttgtaaacaattactgagacacggagcactgttaactgaaattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaagtaagggacacttgaaggcttattttgcttcacagtaaaataacagctctattattattcagcaaggccaaagacttttgagaatgtgtatggaaaattctttttgtgcatttgagggcaaaattcaggccatcttcttatacatatactatcaaattatgttgtgtgcattagaaatcagttgcttgatagtagctattaaacccaatattgctgatagtatgctaatatcctaaaacttaaatattgcatatctatgaatgttaaattcagaatatctctaaaacatggaaaattgatgtttcaataaaaagggagacattttattattttgccttactaatgattttgcagctctgtttttctgcacactcaatagaaaatattgtgggtctgagatgccctttgaaaatgcctgaaagaaaacatgggctactacattatgttaatgttttgtaatgtccttttaatgagtggtgacataaaagggctgctttgttgtcctgatatggcaaaaattaaataaattctttttcactttaaa

SEQ ID NO: 2247 - DNA, 3195 bp, Homo sapiens
  ENST00000502871
cggggcccaggctgtgcgcttggggagcgcggaatgtgaggcttggcgggccgcagcacgctcggacgggccaggggcggcgacccctcgcggacgcccggctgcgcgccgggccggggacttgcccttgcacgctccctgcgccctccagctcgccggcgggaccatgaagaagttctctcggatgcccaagtcggagggcggcagcggcggcggagcggcgggtggcggggctggcggggccggggccggggccggctgcggctccggcggctcgtccgtgggggtccgggtgttcgcggtcggccgccaccaggtcaccctggaagagtcgctggccgaaggtggattctccacagttttcctcgtgcgtactcacggtggaatccgatgtgcattgaagcgaatgtatgtcaataacatgccagacctcaatgtttgtaaaagggaaattacaattatgaaagagctatctggtcacaaaaatattgtgggctatttggactgtgctgttaattcaattagtgataatgtatgggaagtccttatcttaatggaatattgtcgagctggacaggtagtgaatcaaatgaataagaagctacagacgggttttacagaaccagaagtgttacagatattctgtgatacctgtgaagctgttgcaaggttgcatcagtgtaagactccaataattcaccgggatctgaaggtagaaaatattttgttgaatgatggtgggaactatgtactttgtgactttggcagtgccactaataaatttcttaatcctcaaaaagatggagttaatgtagtagaagaagaaattaaaaagtatacaactctgtcatacagagcccctgaaatgatcaacctttatggagggaaacccatcaccaccaaggctgatatctgggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaagtaagggacacttgaaggcttattttgcttcacagtaaaataacagctctattattattcagcaaggccaaagacttttgagaatgtgtatggaaaattctttttgtgcatttgagggcaaaattcaggccatcttcttatacatatactatcaaattatgttgtgtgcattagaaatcagttgcttgatagtagctattaaacccaatattgctgatagtatgctaatatcctaaaacttaaatattgcatatctatgaatgttaaattcagaatatctctaaaacatggaaaattgatgtttcaataaaaagggagacattttattattttgccttactaatgattttgcagctctgtttttctgcacactcaatagaaaatattgtgggtctgagatgccctttgaaaatgcctgaaagaaaacatgggctactacattatgttaatgttttgtaatgtccttttaatgagtggtgacataaaagggctgctttgttgtcctgatatggcaaaaattaaataaattctttttcactttaaatcagatatctcaatgtttttacttggaatcattgcttttctttgaactacctaatatatgtcaagcttcgccacacatattttagaaatgtcctttttgaaagaatgatgtgagtgttttgagtaggttgccaaataggagcaaaaagctcacttctagagtatgtagataattttcaggtttctgaggctttgtgtgtgtgtgtgtgtgtgcacgcgcatgtgtgtgcaggtgtgcacacaaaacaagtgtgttttccccttttgcatgtgaaaagaaggtcttaataatccctagtttatagttcctagttcctatttcatttaggtaattggccttatgagaatgtttaatagatgaaatgctttgttctgaattggtatatattttatgtaaaattcctgtaagaatagtttgggatttaaatttgtattttatatattggttatatgattatgaaaattaaattgatgattaaatgcagatataaaaataagttctgagccgttaataaaggtttctaaataaaaccga

SEQ ID NO: 2248 - DNA, 566 bp, Homo sapiens
  ENST00000505725
tctaatgatatttatgcttctttggtttacaggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggtaatagagccccgccaacctcatcctcttaaaggttaatgttaataaacctt

SEQ ID NO: 2249 - DNA, 602 bp, Homo sapiens
  ENST00000515075
attaaggatcacttaaaaattaatacaggtattttggataatagtaataattattttgaatagaattatcttgaaggacctttttactatggccttggaactttcttgaataattccccagtgttcactaaactcactttttcttttgtgtcactttttcaatagaataatcaagtttgtcattcatacttctagtgtagagctgttctgtgattgatctacccttagcttgggataatgctttatttataaaatagcaatttctgcattttctgtaggcattaataaagtttgctagaatcatcactgatcttagagtggaacagaaaatacatattttttatccttataatgtgcccctaagtagtataatgtgtgtttcataaaacttcttaacattttgatctattcttgcagggttcatgcttgaaccagatccggaacatagacctgatatatttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagg

SEQ ID NO: 2250 - DNA, 6902 bp, Homo sapiens
  ENST00000502613
atttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggttctcctgaaaagaaagctgaacattcatctataaatcaagaaaatggcactgcaaaccctatcaagaacggtaaaacaagtccagcatctaaagatcagcggactggaaagaaaacctcagtacagggtcaagtgcaaaaggggaatgatgaatctgaaagtgattttgaatcagatcccccttctcctaagagcagtgaagaggaagagcaagatgatgaagaagttcttcagggggaacaaggagattttaatgatgatgatactgaaccagaaaatctgggtcataggcctctcctcatggattctgaagatgaggaagaagaggagaaacatagctctgattctgattatgagcaggctaaagcaaagtacagtgacatgagctctgtctacagagacagatctggcagtggaccaacccaagatcttaatacaatactcctcacctcagcccaattatcctctgatgttgcagtggagactcccaaacaggagtttgatgtatttggcgctgtccccttctttgcagtgcgtgctcaacagccccagcaagaaaagaatgaaaagaacctccctcaacacaggtttcctgctgcaggactggagcaggaggaatttgatgtattcacaaaggcgccttttagcaagaaggtgaatgtacaagaatgccatgcagtggggcctgaggcacatactatccctggttatcccaaaagtgtagatgtatttggctccactccatttcagcccttcctcacatcaacaagtaaaagtgaaagcaatgaggacctttttgggcttgtgccctttgatgaaataacggggagccagcagcaaaaagtcaaacagcgcagcttacagaaactgtcctctcgccaaaggcgcacaaagcaggatatgtccaaaagtaatgggaagcggcatcatggcacgccaactagcacaaagaagactttgaagcctacctatcgcactccagagagggctcgcaggcacaaaaaagtgggccgccgagactctcaaagtagcaatgaatttttaaccatctcagactccaaggagaacattagtgttgcactgactgatgggaaagatagggggaatgtcttacaacctgaggagagcctgttggaccccttcggtgccaagcccttccattctccagacctgtcatggcaccctccacatcagggcctgagcgacatccgtgctgatcacaatactgtcctgccagggcggccaagacaaaattcactacatgggtcattccatagtgcagatgtattgaaaatggatgattttggtgccgtgccctttacagaacttgtggtgcaaagcatcactccacatcagtcccaacagtcccaaccagtcgaattagacccatttggtgctgctccatttccttctaaacagtagatacttctgatggattctcggcattaactcctgtttcaaaaaagtgtgaacagttttatgaatttgaaagaaaatttggtagctctttatagcattcattcttaaagatcagtcagaataggtgatttctaaataaaccaaatagaagaatgaagtatctctacagggtagtaacttgattcctcttcaggagaaaagggagctaaattgcaagctctaactaagggtttctgctactgacatcacaacacagaaatgcaagtgtggtacttccagtgaaagcacatggcacctttctaggtgtgtagccactgagaagggacagtgaaactgttatttttgatatcagaatgtcatttttatgtgcatatccctaaaattagggttatttctacatacactagttacacttgtgaattttttttaaggtctcttttaatttccagacagttaaaaacaatctagttatcttaaagcattagaaagttattatctggagagtgcagagatttcagtccatacacctttctccacaaagcagagccagaagtaactgactattgtgcctaaaactctgtttcatttttaaaaacaagtgccattaaaatggaatatctaatgataagcatatgaaataatgtgtaattagctcaatttaactattccacaacttacatattccaaaacaatgttatacatgataaatatatataatttttgtcagttaaaacaaattaaaaaaatggactatcgtcgcacagaagcctagaacaaaaatatgaagagaaatatctgacatttgtaaagaaattataagaagaaaaaaagatacagaacagaaaacattcactactttagaaacactttatgcatggcttcttgccccaaacttttattgtgatggccctaataaagcagattattggaaaaattggaggacaagggttgtataaaaattttattttatgaagaaaatatgtagcggaaactgaattttcaagacatttacaatgtgaaatcatgttgcatttaacaatgtactttattagcaacttcaccaaatattccccaagtcataagcaacaattatttttattaggttttggggggtggagtagttttaataaagtgcacagaatggtgacacccacaaagccttatataaaggcaggattcatgcatcctgctgcaagtacctctgcactaatataccagatcctaaaatgcatataaggtggactagcatcttaattctgctagttgattgtgtctttactgaaaagaacccagctaccaatttgcctttttttacaccacaaatcctaattagaaacttgaggttttatagaaatcatttaatgatagagattacatatgtgaattaatgtgaatatagtatctgtgcttcctgtgtctatgactattttaagatataattgtgctgcgctatcagattaacatttggaagtttctagaacagttaatgctatttacagaaaggagtagaaactcatcaactggcactctctttgatttttatattttaaattaactctcttcgatctcaaagtatattttacgagtaattttattaggaatctcttatagtgccccaatgggataagctatttgcctattttcacagttctgaacttggaaagaagcaaagtatatgtaactaaaccacatatttgtctttttattgctttttcccttcttttatatgctaaatcaaatatagatttgtggatagggaagcaatatgtgaatcacaatgtagcagaggcagaccaagcattacattattatttagagctggactgcaccaattacttgtcctcgtgccaaaggcaaatatgtttgcacctttttttttttttctgattctcaggttgattaatactgctaatgcaaatgctcaagtagatgtttaaaaactttacaaaatagattcaagtgatactttcttttaaaagtgaagagttgatgattacacatagtaaattcatgaactacagtaggtttgtatcaaacaattttttttaatgaaaatctgttgaggtgtacacaatatgcttcttgattgtattagtccttggtctctgctagacctcatgagtttcatcatttagaaaaggggtagaggatgaactaatgtctccttcagatgtaaacatgaaatacctagagttttacttgcttttcaatacactgaataattttaaatgattctgacactgatgtagaccctttgacttataaattctgaggaaacaactgacagcataaaatatttacattcttataacacagcacagtgactttcttctttcaagattgtagctcagagaaaagatacaggattcaattgggggttcaataggatagaaatggagagattcctttgtgttgtagtagaggcattttcctaaggagtatagatttatactttgcattttcattcatcatcccccagaatcatggtcaaggtgtaggtcactccacacagctgatgctcaggttattcccttgtgagaattatgagaataaagctcccaagatatgtgaaagtgcttaacacagtacctggcacacagcactcaataaaagtttggctctattatgggatggttcaattctggtttaaggaaggaagaaaggttattatatatgtaccactaagcaaatatatatatatatatatatttggggttttttttccctaatattatttgggtgtcccctgtgcttctttaggatgtagttataactaaacctgttatacttgaacatcactaagagaagtaaattattatgaagctagcaaaaatcttgaggccaaagttgtttcttaacagctttaataatgcttgttgattttgaataatcctttaaaaagtggaccatttgcttattttaatatcacgtcagtaaaatgttagtattaaaaagatcagctttttatggcattgaagaatgtatctgctaagacacaaaaattgcatggtaagtataataggtggaggaggaaaggttgtaggccggatgaaaatttaactgactagaacatttattcaggagtgtaattattttcccttaccccaatccctgtgtacgtgttgggtatagttacgacattatccggatttgcaaatagacacaactttcagtcttaccctgtttattgtttaagagtgatagactgttgtcctcttgctggtggaaaatctaaggtggagcccactcttctatgctgaagttcaccaggcagagcagttttcttacaagtcagctactctgcttggtttattttaggttttggtacttcacgtaagcactgttagaaggtacaagtgtattaatatcactagttttgaggcgcttgggtacatttgtttttaatatatttagaatgtgcagtaaacttttttctcatttttttttctttttagcaaacttgttattttaggtccaattattgagttgacagtctactgtgagaatgagatgacatatctactgtgagaataccataaatgatgaatagtttatttgagaacttttatactcagtggtgttttatatattaagataaaaatatgtacacacatgcatgtcacatctctctactgtggagttaatgtgaatttttaaaaaatggaattgcaaccacaatcatatctaagagaacattcactcctagtgagggtttacaaaagctactaagagaataaggtagatgataatgcaaagggtcatgatttggggttatttttgttttattttaaaatttatactgctacttttgaaagaattgtttttatgactatgctctttttgtgattgaaaagtcatctaatagaagctgtatagaagctactttttaattgctggcaaacagctttaagtgcactttctttgattacacttccattttttgttaaacttgaattttctgaagccttttatgtaccactaagcaaataactttaacctttaaataaagcaaatttacatctttattgtatttctacttgttacaaaacatacttgctaaagtaacttcagtcctcaaatatagctgggaaacaattatgagatagactcagtctccccctcccaccccttttcccctgccatatctaattaagcactaactgattttattactttattgcctttacactgcttattctttttgactgaattctgtccctgattcactgttttgtttgaaatttaaagttattttcttactgtatttatcatacctgttttaatctgttttctttaaatgcaataaatcccaaatggattgcatattctttataatcagtga

SEQ ID NO: 2251 - DNA, 1170 bp, Homo sapiens
  ENST00000507670
ttaacagcaaccactatattagtgactttaagctactctttttcttaaaatacttaaaagaggatttttgattctggccaagtgagcctacctttacaactttttaaaaagatttatttcatcttgctgtagttttctagtaatagagctgcttctgtagatgattgttttttacgtttctgattttgtcaccaatgtgaaaggaaggaacatagtaaatagatgcagtgctgacagtgctttaggactggagcattgttttgtataatatcatttcttttttcagatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaagtaagggacacttgaaggcttattttgcttcacagtaaaataacagctctattattattcagcaaggccaaagacttttgagaatgtgtatggaaaattctttttgtgcatttgagggcaaaattcaggccatcttcttatacatatactatcaaattatgttgtgtgcattagaaatcagttgcttgatagtagctattaaacccaatattgctgatagtatgctaatatcctaaaacttaaatattgcatatctatgaatgttaaattcagaatatctctaaaacatggaaaattgatgtttcaataaaaagggagacattttattattttgccttactaatgattttgcagctctgtttttctgcacactcaatagaaaatattgtgggtctgagatgccctttgaaaatgcctgaaagaaaacatgggctactacattatgttaatgttttgtaatgtccttttaatgagtggtgacataaaagggctgctttgttgtcctgatatggcaaaaattaaataaattctttttcacttt

SEQ ID NO: 2252 - DNA, 3804 bp, Homo sapiens
  ENST00000335016
cggggcccaggctgtgcgcttggggagcgcggaatgtgaggcttggcgggccgcagcacgctcggacgggccaggggcggcgacccctcgcggacgcccggctgcgcgccgggccggggacttgcccttgcacgctccctgcgccctccagctcgccggcgggaccatgaagaagttctctcggatgcccaagtcggagggcggcagcggcggcggagcggcgggtggcggggctggcggggccggggccggggccggctgcggctccggcggctcgtccgtgggggtccgggtgttcgcggtcggccgccaccaggtcaccctggaagagtcgctggccgaaggtggattctccacagttttcctcgtgcgtactcacggtggaatccgatgtgcattgaagcgaatgtatgtcaataacatgccagacctcaatgtttgtaaaagggaaattacaattatgaaagagctatctggtcacaaaaatattgtgggctatttggactgtgctgttaattcaattagtgataatgtatgggaagtccttatcttaatggaatattgtcgagctggacaggtagtgaatcaaatgaataagaagctacagacgggttttacagaaccagaagtgttacagatattctgtgatacctgtgaagctgttgcaaggttgcatcagtgtaagactccaataattcaccgggatctgaaggtagaaaatattttgttgaatgatggtgggaactatgtactttgtgactttggcagtgccactaataaatttcttaatcctcaaaaagatggagttaatgtagtagaagaagaaattaaaaagtatacaactctgtcatacagagcccctgaaatgatcaacctttatggagggaaacccatcaccaccaaggctgatatctgggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggttctcctgaaaagaaagctgaacattcatctataaatcaagaaaatggcactgcaaaccctatcaagaacggtaaaacaagtccagcatctaaagatcagcggactggaaagaaaacctcagtacagggtcaagtgcaaaaggggaatgatgaatctgaaagtgattttgaatcagatcccccttctcctaagagcagtgaagaggaagagcaagatgatgaagaagttcttcagggggaacaaggagattttaatgatgatgatactgaaccagaaaatctgggtcataggcctctcctcatggattctgaagatgaggaagaagaggagaaacatagctctgattctgattatgagcaggctaaagcaaagtacagtgacatgagctctgtctacagagacagatctggcagtggaccaacccaagatcttaatacaatactcctcacctcagcccaattatcctctgatgttgcagtggagactcccaaacaggagtttgatgtatttggcgctgtccccttctttgcagtgcgtgctcaacagccccagcaagaaaagaatgaaaagaacctccctcaacacaggtttcctgctgcaggactggagcaggaggaatttgatgtattcacaaaggcgccttttagcaagaaggtgaatgtacaagaatgccatgcagtggggcctgaggcacatactatccctggttatcccaaaagtgtagatgtatttggctccactccatttcagcccttcctcacatcaacaagtaaaagtgaaagcaatgaggacctttttgggcttgtgccctttgatgaaataacggggagccagcagcaaaaagtcaaacagcgcagcttacagaaactgtcctctcgccaaaggcgcacaaagcaggatatgtccaaaagtaatgggaagcggcatcatggcacgccaactagcacaaagaagactttgaagcctacctatcgcactccagagagggctcgcaggcacaaaaaagtgggccgccgagactctcaaagtagcaatgaatttttaaccatctcagactccaaggagaacattagtgttgcactgactgatgggaaagatagggggaatgtcttacaacctgaggagagcctgttggaccccttcggtgccaagcccttccattctccagacctgtcatggcaccctccacatcagggcctgagcgacatccgtgctgatcacaatactgtcctgccagggcggccaagacaaaattcactacatgggtcattccatagtgcagatgtattgaaaatggatgattttggtgccgtgccctttacagaacttgtggtgcaaagcatcactccacatcagtcccaacagtcccaaccagtcgaattagacccatttggtgctgctccatttccttctaaacagtagatacttctgatggattctcggcattaactcctgtttcaaaaaagtgtgaacagttttatgaatttgaaagaaaatttggtagctctttatagcattcattcttaaagatcagtcagaataggtgatttctaaataaaccaaatagaagaatg

SEQ ID NO: 2253 - DNA, 3848 bp, Homo sapiens
  ENST00000628286
cggggcccaggctgtgcgcttggggagcgcggaatgtgaggcttggcgggccgcagcacgctcggacgggccaggggcggcgacccctcgcggacgcccggctgcgcgccgggccggggacttgcccttgcacgctccctgcgccctccagctcgccggcgggaccatgaagaagttctctcggatgcccaagtcggagggcggcagcggcggcggagcggcgggtggcggggctggcggggccggggccggggccggctgcggctccggcggctcgtccgtgggggtccgggtgttcgcggtcggccgccaccaggtcaccctggaagagtcgctggccgaaggtggattctccacagttttcctcgtgcgtactcacggtggaatccgatgtgcattgaagcgaatgtatgtcaataacatgccagacctcaatgtttgtaaaagggaaattacaattatgaaagagctatctggtcacaaaaatattgtgggctatttggactgtgctgttaattcaattagtgataatgtatgggaagtccttatcttaatggaatattgtcgagctggacaggtagtgaatcaaatgaataagaagctacagacgggttttacagaaccagaagtgttacagatattctgtgatacctgtgaagctgttgcaaggttgcatcagtgtaagactccaataattcaccgggatctgaaggtagaaaatattttgttgaatgatggtgggaactatgtactttgtgactttggcagtgccactaataaatttcttaatcctcaaaaagatggagttaatgtagtagaagaagaaattaaaaagtatacaactctgtcatacagagcccctgaaatgatcaacctttatggagggaaacccatcaccaccaaggctgatatctgggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataagtgttgtaaacaattactgagacacggagcactgttaactgaaattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggttctcctgaaaagaaagctgaacattcatctataaatcaagaaaatggcactgcaaaccctatcaagaacggtaaaacaagtccagcatctaaagatcagcggactggaaagaaaacctcagtacagggtcaagtgcaaaaggggaatgatgaatctgaaagtgattttgaatcagatcccccttctcctaagagcagtgaagaggaagagcaagatgatgaagaagttcttcagggggaacaaggagattttaatgatgatgatactgaaccagaaaatctgggtcataggcctctcctcatggattctgaagatgaggaagaagaggagaaacatagctctgattctgattatgagcaggctaaagcaaagtacagtgacatgagctctgtctacagagacagatctggcagtggaccaacccaagatcttaatacaatactcctcacctcagcccaattatcctctgatgttgcagtggagactcccaaacaggagtttgatgtatttggcgctgtccccttctttgcagtgcgtgctcaacagccccagcaagaaaagaatgaaaagaacctccctcaacacaggtttcctgctgcaggactggagcaggaggaatttgatgtattcacaaaggcgccttttagcaagaaggtgaatgtacaagaatgccatgcagtggggcctgaggcacatactatccctggttatcccaaaagtgtagatgtatttggctccactccatttcagcccttcctcacatcaacaagtaaaagtgaaagcaatgaggacctttttgggcttgtgccctttgatgaaataacggggagccagcagcaaaaagtcaaacagcgcagcttacagaaactgtcctctcgccaaaggcgcacaaagcaggatatgtccaaaagtaatgggaagcggcatcatggcacgccaactagcacaaagaagactttgaagcctacctatcgcactccagagagggctcgcaggcacaaaaaagtgggccgccgagactctcaaagtagcaatgaatttttaaccatctcagactccaaggagaacattagtgttgcactgactgatgggaaagatagggggaatgtcttacaacctgaggagagcctgttggaccccttcggtgccaagcccttccattctccagacctgtcatggcaccctccacatcagggcctgagcgacatccgtgctgatcacaatactgtcctgccagggcggccaagacaaaattcactacatgggtcattccatagtgcagatgtattgaaaatggatgattttggtgccgtgccctttacagaacttgtggtgcaaagcatcactccacatcagtcccaacagtcccaaccagtcgaattagacccatttggtgctgctccatttccttctaaacagtagatacttctgatggattctcggcattaactcctgtttcaaaaaagtgtgaacagttttatgaatttgaaagaaaatttggtagctctttatagcattcattcttaaagatcagtcagaataggtgatttctaaataaaccaaatagaagaatg

SEQ ID NO: 2254 - DNA, 5734 bp, Homo sapiens
  ENST00000282701
agatcttgaaaacacccgggccacacacgccgcgacctacagctctttctcagcgttggagtggagacggcgcccgcagcgccctgcgcgggtgaggtccgcgcagctgctggggaagagcccacctgtcaggctgcgctgggtcagcgcagcaagtggggctggccgctatctcgctgcacccggccgcgtcccgggctccgtgcgccctcgccccagctggtttggagttcaaccctcggctccgccgccggctccttgcgccttcggagtgtcccgcagcgacgccgggagccgacgcgccgcgcgggtacctagccatggctggggcgagcaggctgctctttctgtggctgggctgcttctgcgtgagcctggcgcagggagagagaccgaagccacctttcccggagctccgcaaagctgtgccaggtgaccgcacggcaggtggtggcccggactccgagctgcagccgcaagacaaggtctctgaacacatgctgcggctctatgacaggtacagcacggtccaggcggcccggacaccgggctccctggagggaggctcgcagccctggcgccctcggctcctgcgcgaaggcaacacggttcgcagctttcgggcggcagcagcagaaactcttgaaagaaaaggactgtatatcttcaatctgacatcgctaaccaagtctgaaaacattttgtctgccacactgtatttctgtattggagagctaggaaacatcagcctgagttgtccagtgtctggaggatgctcccatcatgctcagaggaaacacattcagattgatctttctgcatggaccctcaaattcagcagaaaccaaagtcaactccttggccatctgtcagtggatatggccaaatctcatcgagatattatgtcctggctgtctaaagatatcactcaactcttgaggaaggccaaagaaaatgaagagttcctcataggatttaacattacgtccaagggacgccagctgccaaagaggaggttaccttttccagagccttatatcttggtatatgccaatgatgccgccatttctgagccagaaagtgtggtatcaagcttacagggacaccggaattttcccactggaactgttcccaaatgggatagccacatcagagctgccctttccattgagcggaggaagaagcgctctactggggtcttgctgcctctgcagaacaacgagcttcctggggcagaataccagtataaaaaggatgaggtgtgggaggagagaaagccttacaagacccttcaggctcaggcccctgaaaagagtaagaataaaaagaaacagagaaaggggcctcatcggaagagccagacgctccaatttgatgagcagaccctgaaaaaggcaaggagaaagcagtggattgaacctcggaattgcgccaggagatacctcaaggtagactttgcagatattggctggagtgaatggattatctcccccaagtcctttgatgcctattattgctctggagcatgccagttccccatgccaaagtctttgaagccatcaaatcatgctaccatccagagtatagtgagagctgtgggggtcgttcctgggattcctgagccttgctgtgtaccagaaaagatgtcctcactcagtattttattctttgatgaaaataagaatgtagtgcttaaagtataccctaacatgacagtagagtcttgcgcttgcagataacctggcaaagaactcatttgaatgcttaattcaatcattagtttatttttatggacttcttcctgttttttttttttttttttttgcactgccaatgcattttgtttcaaaagattatttctatagtcagaggggaatgagcaaatagactgaagattgccaccaaggaaaagaactgtatttgtttctgaatgtaacttaaagcaagatttttagtaaatatggacatctatttctctttttgtaatcaaacacaacaacttatcaaactgtttttagaactgttagagaacacactggtttatttttgtaatgttctttgaaaacagaatggagaagcagcaatagcttgtcatttatctcatttaatgactaatgggaaatagagaacaatttcgcgttttgaattaggcttattgccttagaatcctgagaaagtgctaaataatcaactctgatgtttttcttaagttcttgagactcttgtttatccttgtttttcctccacaagtcattgtctaagtgtaatggaaagtttatgctgagcgttagtgtgtatgtatgtgcgtacatgcgccaggtgcctgtgccctctgtaggatggtttgcttaatatggttttataattcagtttacacaggattctttattttttttaattttgtattttggcaaacaccattcagttataagaactttgccaaatatgatagaataattcaagagcatatacagagagttaccacttgacccagctatttaattgcaaatacagttgttttcatttcatttcctaccagaaaaaggaatcagaaacctagtttttgaaaacacaagtgtaattcctcttttgtacttctttttcacaaatgcttttatttattctaaattgaatttaaaaatccttcctaaagccattaactctttaattctcctgatatgcctttacttcctatgaagttattggtagatgttgaggcccaaaaactggtagaatattgaagatcttcttaaatgaccaatttaaccataaccaaatattgaatatcattcttcagtcacatctaagtcaggcactttttcacatagatcagggcttttggctcagtcacgaaatctacaagttagcaaagcttacaaaacattattcgtcaggtatgggaatcaaatatagacacttgtttgtctttgctttccatttctatgtgtcacatacatatatgtgtcctcttataactttagtcttcaaaattatttcaatatccttcttctcactatatttatttgtgtgatggaaatgctttcaggccgtagatcattgttggtgttaatctgtggttaatcctcattttagttccgtcttatctgatacttagaaatatctcagccattttggaggctgtgcagtatcagaagacgtggagtttgttctgtctctgcctgtagctaattatggtggttcagtcatttaataaatatgttttgagcatctattttgtgaaaggcactgtgttacctgtgtgtctttagtgtcctcactggtaaaatgaagaggctggccatgagctggaagggttaagtttataattccagctatttcacacccgtcttccttgaaggaatgatagtgatagatataaaaacactgtaagtccctcttttaataaactaaatgaaagaacatcctatacttcgctgtttgtaaattagtatggcattcgctttggtttaagtggtattttattgcaaacccattaaaagaataactcatgaaaagaagctctttgacaccttggggtacacaaatgttggtgtgggtgtgtgttaattctgtgagtgagacacaccagttctaaaaaaaatgagtgaagttctggtgcctgagttaccatgctttcttctagttcttacagtagcataaaattaaagattcaaagtgagatggaggataaaattactttttaatacatgttctcaaacatttgaaaataaaagtatatgatagaagggggccagagtgtggccaccatcctgatcgtactgtttttcaataaagaaaactttttcattggtagatttggtgaaattctaaatttaggtttttttctagagctgtatcaaccaaaacttctggcaattcccagtatcacttcttagccttcttatatccaaatgcctgtttattacctttcttaatttgaatcaatgcctagttattacagattgcaccccacaatggccaaaaacccactacataataaaatttacaggtactaactagttaagattatattttaagtagcaattgatataaaattacaacacaatgaaagaacttgggtaatctcttagcaatggaaataggttttaaccagcagtttttctgggtgctttgtaactatcattttactaatgaattgaggatgtattatggtttaaattggaagagttttattcccaaagaataaagcaagattatctttcagtagtagagattgaagtaaatgtattaatattttaattaatacagatttactaagagtagttagaaaatttagtaagtgcctgttttacaaattgttaggtactagtttctgtataattcctacacagaagctttagaaatctcctgatattaaattattaaattggcattcatgaaaagagaagctacaattataaactccatttgctaaatcatgcataatactctctctctctcttcccccacaagtaatctctctaccccatgcagtgtgcacacacacacacacacagtcagttactgaaaaaaataattctttttctttttttttttaaatggagtttcactcttgtcgcccaggctggagtgcagtggcgtgatctcggcccactgcaacctccacctcccaggttcaagcagttctcctgcctcagcctcctgagtagctgggattacaggtgtccgccaccatgcctggctaatttttttatttgataaaaagaattctttttctcaataactgttctcttgaattcaaattaagggactgccaaagtcaattagaatattttaaaaatactttgttgtaacctgtgtaaataatatacaatttacaggatttgggattgtagaacttaaactggaagactggattcctcagatctcaggactataacattccagataaatttttacattccctttgctgtatattaactgatgatcatttatatgttaagattttttaccttaatatttctgaataaaactcttattgcccatttaatattttcataggcaatcaaatgtgagtaatactgctaagagtctgatttattaaaaatatttgtataattcattcagtttagtttttcagtttagtctttctgctttcacttttctctgtgctaacaagtaactaatgtctgggcattgacttcttattgaatcaaagttgggttaggcatagctatgcacacctgatgtgtaagattaaagaagagattaaataagaaatcttgggtaagttggacttttctgtatagctcttttttcctctgagttgtattttaatgtagtttataagtgataaaatgatccttgttttctaaaagccagtccttcccttcagctttccacagtttctgtaaatgtttaatacttgtacagtcaatggcaattttaaatatatatatatatataatatatgtatatggaaaaggttcaaagatgcttttaatttatttaatgactattgccttcctataataataattttcatccttaattatgataatacttttagcaagaaaaattcctttttactacagtttttagatgcaaaatgcagtttggttctttagtcaaatccacttagagggtatattgcagtgaaactgtgaaggatacttcactaccaatgtataagctttgttgaatttgtatcattttctttcagtaatgaaaagctattcattatacagtatggaaataaaaattgcttcattga

SEQ ID NO: 2255 - DNA, 844 bp, Homo sapiens
  ENST00000448280
ggacagtggagacgcgccttctcggctctggtccgcgccctggggccctggcctccctggaggggctggggaactggaagctgggccgagagagttcccgctgcagctatcgcgcagtccctcctgcgcccgggcgcccccagcgggttccgggaggcgcccggtgagcccacgtctgttgcggcggagcgagcgcgctccgggagggccgagagccggcggggctggcaggagctctcgggcgcccgcctccctccttcgcggacggtctcccgacacgccggctgagagcccttttcgactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttgcatgagccaactagatggagcaatctgacacaaaacccagggttttatgactgacctagtgcgccagctgcatctggaggaaccagacgcaaacaacgcagagttgagggccaggtgaagcgggatccagctccccacttcaccccaaccccttcgactcctcaaaacctctgcaagaagctatttccttcggctggcaacttacagccagcaggtcccttcctcgtgcagaataaagccattctgggaaa

SEQ ID NO: 2256 - DNA, 5031 bp, Homo sapiens
  ENST00000297161
ggacagtggagacgcgccttctcggctctggtccgcgccctggggccctggcctccctggaggggctggggaactggaagctgggccgagagagttcccgctgcagctatcgcgcagtccctcctgcgcccgggcgcccccagcgggttccgggaggcgcccggtgagcccacgtctgttgcggcggagcgagcgcgctccgggagggccgagagccggcggggctggcaggagctctcgggcgcccgcctccctccttcgcggacggtctcccgacacgccggctgagagcccttttcgactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttgaacaaggaagtgacatgtaagagagagaagtgccccgtgctgtcccgagactgtgccctggccatcaagcagaggggagcctgttgtgaacagtgcaaaggttgcacctatgaaggaaatacctataacagctccttcaaatggcagagcccggctgagccttgtgttctacgccagtgccaggagggcgttgtcacagagtctggggtgcgctgtgttgttcattgtaaaaaccctttggagcatctgggaatgtgctgccccacatgtccaggctgtgtgtttgagggtgtgcagtatcaagaaggggaggaatttcagccagaaggaagcaaatgtaccaagtgttcctgcactggaggcaggacacaatgtgtgagagaagtctgtcccattctctcctgtccccagcaccttagtcacatacccccaggacagtgctgccccaaatgtttgggtcagaggaaagtgtttgacctcccttttgggagctgcctctttcgaagtgatgtttatgacaatggatcctcatttctgtacgataactgcacagcttgtacctgcagggactctactgtggtttgcaagaggaagtgctcccaccctggtggctgtgaccaaggccaggagggctgttgtgaagagtgcctcctacgagtgcccccagaagacatcaaagtatgcaaatttggcaacaagattttccaggatggagagatgtggtcctctatcaattgtaccatctgtgcttgtgtgaaaggcaggacggagtgtcgcaataagcagtgcattcccatcagtagctgcccacagggcaaaattctcaacagaaaaggatgctgtcctatttgcactgaaaagcccggcgtttgcacggtgtttggagatccccactacaacacttttgacggtcggacatttaactttcaggggacgtgtcagtacgttttgacaaaagactgctcctcccctgcctcgcccttccaggtgctggtgaagaacgacgcccgccggacacgctccttctcgtggaccaagtcggtggagctggtgctgggcgagagcagggtcagcctgcagcagcacctcaccgtgcgctggaacggctcgcgcatcgcgctcccctgccgcgcgccacacttccacatcgacctggatggctacctcttgaaagtgaccaccaaagcaggtttggaaatatcttgggatggagacagttttgtagaagtcatggctgcgccgcatctcaagggcaagctctgtggtctttgtggcaactacaatggacataaacgtgatgacttaattggtggagatggaaacttcaagtttgatgtggatgactttgctgaatcttggagggtggagtccaatgagttctgcaacagacctcagagaaagccagtgcctgaactgtgtcaagggacagtcaaggtaaagctccgggcccatcgagaatgccaaaagctcaaatcctgggagtttcagacctgccactcgactgtggactacgccactttctaccggtcctgtgtgacagacatgtgtgaatgtccagtccataaaaactgttattgcgagtcatttttggcatatacccgggcctgccagagagagggcatcaaagtccactgggagcctcagcagaattgtgcagccacccagtgtaagcatggtgctgtgtacgatacctgtggtccgggatgtatcaagacgtgtgacaactggaatgaaattggtccatgcaacaagccgtgcgttgctgggtgccactgtccagcaaacttggtccttcacaagggaaggtgcatcaagccagtcctttgtccccagcggtgacctttgtttcgatccttaagactctgaaatctggtgactttgacactgaagcggaagagccaatgaaggactgcagtatttgtgtgcccgattctgtaaacacacacacacagagtatatatgtgtatatatatatagatatattcaaaaacattgcatcatttatatgaactatagggggattattatatgtatattttttgctataagacatgtattgtttctaggatcctaacctgtaagccattgaacatgttgtataaatacaccaggtgtttttaatttaataaggtggcatgcagatacattggatagtgttaacatcacatacatttgtcatttttaaggaagttttctaagagccctcaattgcctgcctgtattaattttagttttgagtcaggatttgtaatggagtgggaaatgtgtttctctggagaagggcacatttatctaggggcatttcaggtttccaaagaaaggaatgtatgcctgggaaagacagcaggagattggtgaccggccctaatggtgcatgaaaagcgagtgataggctgttagaatgtattaggtcatgggctaacattatttccaaaattgattggctggttgccaagaaatatatatttgtcactagggcataaccgaagaatcaagtgatttcttgccatccttgcgtagtcctcaagtcttctaatcatctatgtgtgtatgatggatgtgaccatttatatgtcatgtgttgaaattaaagggtgtctggatgccatgttaattttattgagcatgagaaagtatttgaagaaactgttgcacaacatatgatgaaattttgatttctctgaatctcagagtaatttaagatgggcaaatccaatgagttgatgtaacccatctacattttgtggctatttcatgtataaaatgaaaggctttagttatttctagaggagtcccatccaacactatttggcgactgttaatatgttataattattagacagtggaaaagcctttattgactaattgatttaacctcagtccaaagaacagtctctatacttgccctcatttactgataggctgctactagttaccatttgattgtcttgactttcgtcttcagttgaattggtgaaaacatcaacaaaaacaaaacccactgtgtcttaaaataaaatgttctgcattgtagtcaataaagggcttaagatgtaaaacaatgcattttctctctcaagatgtcctgtgttatactttacaattagttgtatcaacttcagattcattaaattttaacagctgtatttagttataatttttgtatcttacaacagtatatataaagactattattaatagacaaaagcaaacccacgtttttgacaagccagcatattgccaatgctcgtcaaagacatttatgtttcttttacattcatgacagctaaagtattaacttggaatttttttttttttttttgactggaaaatccctagttgtttgaattaactgaataaagtgcagggcgtaatagtgactggctgggggcactgggcctttgtgttttttttcattcctgtgtttggatactaatcaccctcgtatctgcagcctgaggtagtcaggtcattgtttcaatgctgcccttggaaagaagactttgacttaggtgctttgggatctaagtgtggtttgtgactatccccattatttaagcatttgggggtctcacttttgcttatctgtaacacaaagaggccatgtagtatagtgagcagggttgagaatcgggaaaactagacccctgccactaacaggctaggagactttgggcagtaatgggaggcactgagggtttgcaaatactttcctacttgtaatctcattgattccctgctctgccctgacaggaggggtagggaaaatcagttgacgttgcctggtggttcctaccttctgtaaaacgaacagattccttaagattagctttaaatcccttttcagttcactgttggttctcatctttgaaagagggcagcataagggaaatgatggagaagggagaattgtggatggttatttatagctcatgattcatccaaggactgagttattctccccatgaggctaaccggcctctttcccaacacttaatcatggcagccaggatgggtgaatgatgaaagctcttctgcatgagccggtttcatcatcttgggtgggttgattacaagtttgtgtggcattcctttagctggggattagcttaatctctgtacatttttctcatttctaattgaagaagaaagggagggcagagaggacagaaaattacttgggtttactaattcaaagagccatctctgatgggagagggtgaggaaatcagctgaatggttggcctgcatattcttttttaggccacaggctacagctgagcaatggcttagtctaatgattgggcacaatgaggatttaccaagtgcttcaatgagagcagtcctgtttcattcacatgggatgttttcaattggttcttcaactaagctcttgcagagtgagatgacttgaaataaaaatgttctatgaatattg

SEQ ID NO: 2257 - DNA, 602 bp, Homo sapiens
  ENST00000496609
gacggtctcccgacacgccggctgagagcccttttcgactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttgaacaaggaagtgacatgtaagagagagaagtgccccgtgctgtcccgagactgtgccctggccatcaagcagaggggagcctgttgtgaacagtgcaaaggtgattgatgtcttggccgtcttctcttctggctgctgcttcaggcatttttatttctctttctctcaccttccttttcactcagcttttggctggggtgcacatgggtggggaggagaagtagggtgtgtgtgtgtgtgtgtgtgtgtatgtgtgtgtttgtgtgtatgtg

SEQ ID NO: 2258 - DNA, 565 bp, Homo sapiens
  ENST00000436222
cttttcgactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttggttgcacctatgaaggaaatacctataacagctccttcaaatggcagagcccggctgagccttgtgttctacgccagtgccaggagggcgttgtcacagagtctggggtgcgctgtgttgttcattgtaaaaaccctttggagcatctgggaatgtgctgccccacatgtccaggctgtgtgtttgagggtgtgcagtatcaagaaggggaggaatttcagccagaaggaagcaaatgtaccaagtgttcctgcactggaggcag

SEQ ID NO: 2259 - DNA, 547 bp, Homo sapiens
  ENST00000444773
gactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttgaacaaggaagtgacatgtaagagagagaagtgccccgtgctgtcccgagactgtgccctggccatcaagcagaggggagcctgttgtgaacagtgcaaagtgcttgtctcaagggttttaagggacacagtcctgttcactcttaaatactggagactcccagtattttggttgcacctatgaaggaaatacctataacagctccttcaaatggcagagcccggctgagccttgtgttctacgccagtgccag

SEQ ID NO: 2260 - DNA, 551 bp, Homo sapiens
  ENST00000494786
attcagattctagagctcattctgtgtggtagctctgcctttcattcactaattttttattgaggttttgtttcattgctcttctgaaggatagaaggcacagaggactggcccctacccccaagacagtttagcttggaagtaaagtcaatgtctccttacaggattgagcctttatgtatgtgccaaaaattatgtatttgtgtgccccaaatacaggggtatagatggcaacagagacatagaaagatggaggaggttactaggaactgaaggctctagaagacttcacagggaggcaggacacaatgtgtgagagaagtctgtcccattctctcctgtccccagcaccttagtcacatacccccaggacagtgctgccccaaatgtttgggtcagaggaaagtgtttgacctcccttttgggagctgcctctttcgaagtgatgtttatgacaatggatcctcatttctgtacgataactgcacagcttgtacctgcagggactctactgtggtttgcaagaggaagtgctcccaccctggtggctg

SEQ ID NO: 2261 - DNA, 538 bp, Homo sapiens
  ENST00000476525
gtgcctgctctcctaggagccctgcctgctgcctacacccaccacagccactcgttttggcacatctgatgtttggaaatatcttgggatggagacagttttgtagaagtcatggctgcgccgcatctcaagggcaagctctgtggtctttgtggcaactacaatggacataaacgtgatgacttaattggtggagatggaaacttcaagtttgatgtggatgactttgctgaatcttggagggtggagtccaatgagttctgcaacagacctcagagaaagccagtgcctgaactgtgtcaagggacagtcaaggtaaagctccgggcccatcgagaatgccaaaagctcaaatcctgggagtttcagacctgccactcgactgtggactacgccactttctaccggtcctgtgtgacagacatgtgtgaatgtccagtccataaaaactgttattgcgagtcatttttggcatatacccgggcctgccagagagagggcatcaaagtccactgggagcctcagcagaattgtgcag

SEQ ID NO: 2262 - DNA, 365 bp, Homo sapiens
  ENST00000634565
atggagactaaggaccagaagaaacaaagaaagaaaaacagtggacccaaagatgaaaagaaaaagaagcggcatctgcaggatctccagctaggagacgaagaagatgcccagaagagaaatcccaaagcttttgcagttcagtctgctgtgtggatggctcgatcctttcacaggactcaggatttgaagacaaaaaagcatcgtattccagtggttgatcgaactccactagagcccccaccaatagtggtagtggtgacggggcctccaaagttggaaagagcactttgatataatgcctcattcagaacttcattggcagaagttgactgagatcagaggccctgtgatgatcgtgtcag

SEQ ID NO: 2263 - DNA, 12844 bp, Homo sapiens
  ENST00000380672
gcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaaggaacttcttatagttgtcttttgtgaactttaaggttttgaaagaatcttcaattaaagcatggcagattcacctgtaaatatttagccttgaggggccattgatgtaaaacaattgtattgatggttgtttaacttttttgtttaatttttacagttacatccagctgttagatatgcaggaaaagatagtttgctggctagctctattcatttatgttagcattaatgcacatttttaaaaaaagaaaaaaacatggtcttgtttttactacctgttagatatagtgctaaagaggtgctggcatgctttacagcacagatctgattttttaaaatgtcctgtactagtacataaatcccgtcatgcactttttttcatacactacaaggggatgtgtaataaccatgcttcttttttatccttaaactattgccatacttcagtaagtgtcttttttaaaaaaaattcacttgtataaaaatggtctggtcagtatagggcacaaatgccaaacaaagtattagtgttaacacaaaactgccaactttgcacaagtttccagaaaagaaaatacaattagtcactcaacataaccacaggccaatttgttggccaccagaaaaccgctttttaaaaaaacacttggtgattctttcaagtgccgaatgttattagaatcaacattgcatccttcttgcttatacgttaagttacataaaaggaaaacaaaattatgtggtgtgaaacagccaaggcatttattcttcagaggcaggataatatttcaggatacaaaagcccaaattacccgctacggaacaaagatgaatacagtaaaagagtcgaacactcatttccaaggccctaacccttatcctttaaaaagaaatcctctgaactgggtcggtctgttgtatggctgtctaatttgttgcaaattctgcagtcgtactataattcaggcctgtttggtagacaaaatcaaaaggcatttaacagcagcagtacttggaagctttgaaaacatgtgctaaacttgaatggagcaacactcctttctgaaaagccagaagaagggggttttaaagcaggatctctcaatgttcagtgttttgtgtttccccacacgatttgtcagagagaaatgaaagcaagcctgaaaccaagcaattgagagtgagaaagaggagagagactattctccaaaccttttttgttttgttttgtttccgatgtttacacatgttgcctgagctggttaaccacatcggcagcctcagctaccacaacatactgactaaatgatgatatttactcaagttcagtctgcagccaaaaccattagggtgtgcattgcagactgttttgttgtcttttttttttcttttttcctttttttttaagtggaggggaaaagaagagataaacaaggaatattttgtcaaacagtacacaataatttaaagagaatgtatttcttttttgcatttaatggcctcagacatttctttcatcagtctaaaagttagaaatatccctttattttaacttttatgtcgtttccatttttcatgtttttgtaattattttttctatgttcacatcagcattcacttccgttaaatttgccaaaggaaactgttaatatgtttctgttgttattattcctgtaggatttattgtacctcacagtatttattgtttcccaaaataagcatcattagttggggattcagtatttttgttgtgaaaatttcagaaacaatagattcttaaagataagctagctatgtctaggagctttatcttttcacctccttcagaggatgctatggggtccattttaattcttcatttgttctacggggaggaaagaccaaaagtatttgcagtacaaaagaaactatatcaaacactatgttaaatgacaagtgtttatggtaaaaagctgaggaattagtaataatcgtttttgttttcttgtactttgaattccccaaagtcttaattgctttattttggtgttgtgttaaattgaacagacagatgttttcctttgttttataccatataagactctgtacagtatgtttgtgaaagattgaactagaataatgaaagtttgtttgcaaacattttggtcctctcagcgttctctgtgttgtgctgttgccccattaccaaatggttagattcaaaaagggtgggaaaagatttttaatatcccaacaaaacattatagaaactctggcttttgcagtgtgcatagactacatgtagttttatgaaaataaatacacatttttatttcagcaactttgaaaagttacactcagttgagttactagaactcatcttgtacaacagcaatgtttagtctgtttaatttaatgtcaaataaaaggtcagatagccctcgtgagtgaattacatagctgtcggcagtcacatcagcaaatgcaccaggcttagaacaaatgtttgttacttgctgcaaaccaagctaatgtgtatagccagttagaaaaagtccagaagtaatgagattctagaagtagagtttcccttgcttggaaacatgaatgtgttcacctgtgttttgtcagagaagtggcaataagtcctggacagctgacactttttaagtatctcccctatttgctactacttttgtgcctcaagtgcccagtcgttacggtggccttctaaatgagtaaataacattttccaatataaagcctatttgcttaaaagggacaggggagtggatggatgtagtacatgcaatggaaaatcataaaatgtacaattcttctgtttccaaagtattgctcgttcttgagtgtgtgcctgagtgtcttgttttgacttaactagaattctagttaagatggtgatcccatggcttatttgcaaacaggaaggataaagagatcagcgttttagtcatggagctcatctttgcccattcctactcatttgctttttcataggagttttttgttgttaaacagtttctctcaagccacatgcattctatgctggctgaaaattaatagtgatgtagatgttcatccgacaagcttttccccatgtgattggttttagccagagtttatcacaggtacaaaattaggcggtatgactgtgcatgttctctagctgatgttgaaacttgtactgtcttgatcatttaaaactatgtttttgtaaatatcaggtttagtccgctttcgggaatatctgcatgctatggaaagagagaaaaaaaggatagataatgaggaatttggtttaaaagtgtgataaaaatccttggcattctttgttctgatattaattgtatttaaataagtcaacccaatgtaactcattccagatcttagtccagctgccctgttcagcctgatgccttttaaaggtttaaaggtgttaatgttttccttttcaacatggcaaacattttttaaaacctttttggcacaatggtgccactgtcctcatagtgttatttctttggtcatgaattttcaggcccttccagtaagaggagaaaggcacttaactggttaacagccccattattatacattgctctaaggaaaaaaaaaaaaaaaaaactttgaatatatcaagaatgggctattccagaggcttctcctcaggagaaactatgcactaggttcccaccaaatacaatgtgacctttttttcccctttctctgtacacaccccagatatgtgccaagcaaatgagaatgagggccgttgacaattaaagcataaagaagctagtcaccagattgagatggacatgctgctaactgctgacagcttgacctgagcagtcctaacttgtatctggtctgttagcattgggttagattgactaacagagtaaataaaattcacctgtcataagacacgctacatctgctatcatcaagaaacaaatcatccagaagaaactttttttcatcctgtggtcacacccttttcttaagagcttcttttttaaaattatgacaaacgaatttcattctttaaaatcacttatcttctcccaaacttgaagtatttaaattaggtggttttgcttttccctctcattgtttattttttggggatggatctaaatgagtaagatgagcaataaaagataccagaaagactggagggatcacagtgttttcatcagaactaagtagagggtcggttcctgccctggttttggggtagctagaaaaggaaatcatgaatgcactggaaatgttggctcgagagaaaagactggcatagctctgcctcgcagtgggtgagagcgtattgatcgtagggacctgcagagttcctatgaccaggtgagtcggctctgaggaaggggttaggaaagcaagtacagctgcatgaaatagctgaagttcctttggggtcaggaagagccgacaattgtggggttttggttgcttttgctttgtttttgagtgggaagtgttgctggaatcccctgagaaccgaaagatgccaggggtcagcaaggctatagaaaaggccagtggtaacacctcgttttcatcctaacagaggagtaggtgcgaatggcaccagcatggatcgttcctttcttgatcattactcatgcttgccactgtagcaacacaacaaagccatgattgtaattaatactaggctaaagaccttgatcaaaatgggagctcatttactgttctatgaggtatgtaagtaacttctcttcacattttccctcagagataaaccacacgtggtagtcttgtttgcgttagtactaaggtcatgtttgatctgtcccagacgagtcgcatatttcctgtagctggagtgttgctcaccataaatggtcattttcaaaaagtattgtgtaattccagctgtacaactgaccagtgagttatctgtcatcactgttgcccacatacccgtccttccttgtgtagtttcatcatcctcatccttcccacatcttgcgcaaaatgattttctgtgctcattcggcaataactatgttattcggcatactgtctttttggcatttgttgaaaaatccaaatgcttttaatccaaaagattaatccaaatcttttttaatccaaatgattttaatccaaatccaaataacaggaggttaaaaaaaaaaaaaaaactaagcatttttacatgtacactgaattggatcagcattattgttcattataatgctatatatatttttggagcaacatactatagttgtcataaaactatctttattcttctcctctaaagtgctgttgtaaattcatttgacctttactgcaggaaaaaaaaaaatcttttttatataggatatgaagaccaaggctcagtctgtaacaaatagtggaccattacaaaagaggaaagaaaaaagccagggctgagcagcaagaagcttcagttcaatttcacctcgtatctttctaataacatacttgtcactttattaccttccagtaatgtgaacgctgctgacaagactgtcacactaacagcagacaacaccctctctgcttcagcccagctctcctggctacttattgccctggccctgaagggacacaaactaatagtgtgctttccagttcagcacttggccatcaaatataaaaggatgcgtaattgcctgtttatccccttgtgaaggagaaattgactacaagggctaggctttcccatcgagttccctgatgtacacacacatccacaatcagtcagtctctctctctctctctctctctctctctctctctctctctctctcccctctctctctccttccctcttattctcccctcctaacatacaagcacatacacacacctactgtatctgtgggaagcccaaggctgcctctcgatgccctctccagctattaagtggacagtaacaagatgacttcttaaataaagggtcagtagagagatgctgtctgtgacggcatcctttgcttctttgaaaacttaagtgttaacaattccatcttgagagtaatgggtgtggccctataattagagcaaattttcctgcaagtcagtggcataagtaagattatattgccccctaatctgtagggaaaagattaaaatatttttcttccccttcaaaaagtgcacatgttgtaaactggttacgcacagtggtcatttttttttcttatccttggcatcaaaccatggacgtaggtgtacaaatgcatctttcaatgacccctccaaatccatagtgtaacatgatagattaacttttgtcaaactggactgacaatctaaaaaagatggcgtcaggcttttgactttaatcgttaaaacaaggaccaccctatgagtaaaaggtaaattctccactttgaagaactttggtaagtacaagtacagggagctttagaaaatcgagtgatggggaccaaaggtacaaaggaagaatacatgaaaatgttatattccaaaatgccctgagcccaaagattggctgctatttttgtatattgaaatactcaaatgatggttggaaagtgactagttagtgactaaatgaagtgcaagatctatcaagcgtcttctttctgggactaggggatgccatgcttccttccaaccttcccgcagcgcatctcagagaagatagttggccccattacaaacagtcacatttcagtaagatattagtcagccaggtaagacacgtgcaggtatcggtatcatcttccatatgaactttagcaaggagagaacagcagcagatttagggatagacaatgtaacaggtctatgttgacaaatctgtgctaaataatttcatgaaccagtgtggggactgggaagaaaagcactttgagcaaggactcttgggttcgagcaaaggcaattagttgacatgatacttcttaagttcctcagtatgtatatgttacaatcgtttatcagacatcttaatagaatcctaattgaaaaaccagttgccaaaattgcacaagttctgctcgctgatactagctttctccccttaactctaaaataccagggatgcttaaggacgtttgtaatagtttttttaatgctttgtttcacttttttaaaaaagaatctttgaagggaaggaagagcagaaagaagtattttaagaaaaatggagagaagtagatagtattgaaagtatatttcttgaagagagagtatctaagtgctataccaagattttatagggcttcctgttgccaaatgtgatgttgagataatgcacagctaagatggcaaatccatcaattattaactggctctgcccacttctgtcatggaatgcaaggattgagaggtgactctggggagaccctgggtgtgtgagagagctccattcatctggccctggatatgtttttcaaaagagagggagaaagcgccagtccctgcaaggtgaactgacctggcactgtttcagtgggagcctcactgcctgccttttccatgctaggagacaaagcatcctctaccccatctgtgaatcggtgctgtggccactgcgagaagcatgattcatgaggtatgatgctcttgagctcccagacaatgtgctgagttaataggttcacttgagatgtatacaccaaggctgtttctttttttaaatctagtccccaatttggagtatttttgcatgtttttgtacagagtaatccattcctctcattgtgtatcttaatctcctctgacttttccattgtctttctcaatcccaccctttgctcttcggatctcaccaaccccccttaaaaaataaatcatgtttgagcaagaaggtagaacacgccctccctcatcttggttttaattgctttggaaacgtgttctaccctgtccagggtttgcataacgtgaattaagtgaatgagatgttctagtattatatcttaacctgataagactatctaagatttctagtatatggtgcatttgctttcctgtgcaaactttggttcagctgccctgcagagaatctcaccattttcctgccagtgccagtataaagaatgcaggagagctaaacctgggtacatgaaggtcagaggggtgaggacggtcgagaaatggggagaagacttgggcttgagacgacctgggcttttcatgtgtagctcactcagcagtatgaggatgactgacacaccagtgggtggtttccaagtgaggcaaatgcccatttcccctctcccctcacaccttgcctggcttcttccatgaagtccttgctgcttttctgcctccccaaaggtgaggggaaggggctggttggggatctgggaaagccagttctctgttctctcctgctggtgatggactaggccttttagaactagcaagatccctcacacagctgggagaacacacacctttcttactccagacccattggtgtgtctccagtaacaaaattattggactcagcctccatatttgacagcaaaagtggccagagggagttgaaatatcttgaagaaaaggaattttcactaagatatgtcctctccctctcccagagtttagctgtttattccttttttttgtttatattgttctcatctgcataaaaccagtctcttgcaataagcctgccgcagaatcaaagtctgtacttcaaaaggtaactgcaccaagggatgggacagtgtgcatcaccctgatctaatcattgtgacgttggtagcttcctaaatactgtatgtaccttgaacaagggttttatttttgttttgttctgttttgctttttgtttttattggtaggctaaggtaattaaattttttaatttgctgttactttggttgtattttctgtactataactgcctacagtatgtcttttgcataaaatgcataagggtttggggatgtaaatggaattttattcatattttgtccaaatacctcttgtaatttgtatcaaaattcttgtacaatttttatattaaagatttatcagtcactga

SEQ ID NO: 2264 - DNA, 4841 bp, Homo sapiens
  ENST00000484726
gagagaaaggccgagacggagggagccagcggcggccgaggggctggtccaggcgcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagatactgggagaagagcaatgagcaaaacggtctccttgtatcatggggagagactctgtcaagcctaaagtgagcctcggatcttcctaatgacctcctgctggcccagctggatgcaagacaagctcgtttaagcctctgctgacctttcactcctccactacaagaactgcaccactcatttccaccgtcttcagaactgtgcaccaaatagaccacaaagcttcatggctgacgaatgatttccttttcatgatgcaaagagatttttacaaatttctattgatgagagttaacattaagtctcttgtggcattataacctctgttgcacaaatacaatgcttctatataactcttatttttaccttccttataaaggaacaatctactgttcttgccagcattatcttgaaaattcaggccaaaatatctgagcagaatgcacatactgagtgcaccggtggtatttttcatgaagagaccactttgaaagggtcttcctgatttccacctccctcagaatctatctgaccttctcacagactttattggtgtgaatctttcttatatttaaccatttatttgagatgctcatttttgtagcccatcttttctttttaaaaaacatgggctggtttctacccagaagagggtggtaagactgtacatgtacgttaacattcacttgtataactcagcaaaagattagaaagctgatcttattgtcacaagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaaggaacttcttatagttgtcttttgtgaactttaaggttttgaaagaatcttcaattaaagcatggcagattcacctgtaaatatttagccttgaggggccattgatgtaaaacaattgtattgatggttgtttaacttttttgtttaatttttacagttacatccagctgttagatatgcaggaaaagatagtttgctggctagctctattcatttatgttagcattaatgcacatttttaaaaaaaga

SEQ ID NO: 2265 - DNA, 2106 bp, Homo sapiens
  ENST00000411752
ccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagaaacagaaatttacggatggaaagaaccataggtccaggacatcgagacagcctgcatctccgaagaggaaattctaaccggcctggaacctgctgtcttcatacgggagattctcttgaagagagcgtgatagtcagaattagctgcaaaagattagaaagctgatcttattgtcacaagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaa

SEQ ID NO: 2266 - DNA, 3673 bp, Homo sapiens
  ENST00000418777
tcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagaaacagaaatttacggatggaaagaaccataggtccaggacatcgagacagcctgcatctcctgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaa

SEQ ID NO: 2267 - DNA, 3361 bp, Homo sapiens
  ENST00000380667
cggcggccgaggggctggtccaggcgcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaac

SEQ ID NO: 2268 - DNA, 1211 bp, Homo sapiens
  ENST00000380666
gctccaagaccggcccagacctctcgtttcatcttgccatgtcacgagtcaatgctgtgtcgtcttttcaaaaatctgcctgatttagacaagaaagaaaagtactttcatgttgcagccgcagtcccctgctaacttgtcagcagcaggatatgattcacttgggcccagaagaatggaacagagaggcgggttaggcggttcaataaagcccacggacagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcc

SEQ ID NO: 2269 - DNA, 1008 bp, Homo sapiens
  ENST00000603713
aaatgatagggatatctgtgcagaaggtgcgaaagaagctctgaccccctccctcccccaaatctcccccttcccaaatgaaatgcacagttcagccagcttcttaactacactacactcctgctactggctgccaagaggctcaaaaaatccaccttcacttttcagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgctt

SEQ ID NO: 2270 - DNA, 688 bp, Homo sapiens
  ENST00000486514
ggggccgcggcgagggcgcgcgcgggcgggcggggaggcggaggcggcgagagcggaggcccggaggaactcggagggggagggagagaaaggccgagacggagggagccagcggcggccgaggggctggtccaggcgcggccgctaagaggagaccaagaggcgggggctgcacttgacaaccagcatgccgagatgtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgc

SEQ ID NO: 2271 - DNA, 545 bp, Homo sapiens
  ENST00000603313
agctgttaaactgagcaaaggcaagcttggggagtcacaatctatgcataaatgatagggatatctgtgcagaagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaaga

SEQ ID NO: 2272 - DNA, 662 bp, Homo sapiens
  ENST00000468187
tcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgaaaccctgaaatcgtgtctccaatgacttctgctcagaggtgaaacacagcattctttccggctgccttatactgtgcagtgtcctgggtgtggggcaatgaggaagtgacttgggttttctagtgtgtaattttcctctgaaatgcatggaacagcaacaaaactaccaagatacattgcccagaatggtttcatggtagcactgaatgcattctacctgtcattatgtcaataaaaaaatttttaatatctgctgctaaaaaataaccaaatgccaaaatcatgtattctctctaaaacagatttttagaaatttgttgacctcctttcttgaataaattatccttgttaacagca

SEQ ID NO: 2273 - DNA, 745 bp, Homo sapiens
  ENST00000471301
ccactagcatgaagctgatttgctgtgatggtcacttagaagggtttcgctttttcctaaactgtggctgtttaaagtcttggagtctggacaattaacagctgaagaaaatatgacaagacacacgcaaagaggttgggagatagagaggaggagtgcgccagaaaggagctgagctgccttcttgtgtaaactgcctgagagcgggccccctcccctggcctccgtccctgtccccccttccccaaggctgtgttctgctgtctgcccgaaggccaggactgatctgttaaccttgcaccactggctgggaggccgctgcagctcatggccatccgttgcacactggtaaactgcacatgtgaatgttttcagccagggaagattaacctgaggacttgtgatcagtgtaaacatggctgggtggcacatgaaaccctgaaatcgtgtctccaatgacttctgctcagaggtgaaacacagcattctttccggctgccttatactgtgcagtgtcctgggtgtggggcaatgaggaagtgacttgggttttctagtgtgtaattttcctctgaaatgcatggaacagcaacaaaactaccaagatacattgcccagaatggtttcatggtagcactgaatgcattctacctgtcattatgtcaataaaaaaatttttaatatctgctgctaaaaaataaccaaatgccaaaatcatgtattctctctaaaacagatttttaga

SEQ ID NO: 2274 - DNA, 561 bp, Homo sapiens
  ENST00000613349
tagagggagctattctttttgttgttgttcctgggaatatttcttatattaagggagtccaaaatagatgatgacttgaagttagtggtttcctttacttttaattttacagttaagggttcagcacggttttaaatattccttaagtatttgaaagatggccttagtgaatatgaggagttcaatttagtactgttcacattcacttgtttgagatgatttgccagttgacaatgtggcttttatggttattgtaagatggcatacttcaactgtattatttatagtcttctaaacaacctacgatccccaaatatccaatactaaattgcagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactg

SEQ ID NO: 2275 - DNA, 687 bp, Homo sapiens
  ENST00000617779
tagagggagctattctttttgttgttgttcctgggaatatttcttatattaagggagtccaaaatagatgatgacttgaagttagtggtttcctttacttttaattttacagttaagggttcagcacggttttaaatattccttaagtatttgaaagatggccttagtgaatatgaggagttcaatttagtactgttcacattcacttgtttgagatgatttgccagttgacaatgtggcttttatggttattgtaagatggcatacttcaactgtattatttatagtcttctaaacaacctacgatccccaaatatccaatactaaattgcaggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactg

SEQ ID NO: 2276 - DNA, 3750 bp, Homo sapiens
  ENST00000545497
agacggagggagccagcggcggccgaggggctggtccaggcgcggccgctaagaggagaccaagaggcgggggctgcacttgacaaccagcatgccgagatgtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagaaacagaaatttacggatggaaagaaccataggtccaggacatcgagacagcctgcatctcctgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaaggg

SEQ ID NO: 2277 - DNA, 582 bp, Homo sapiens
  ENST00000464546
aaccgaccgagggggtcgggggaggctgcgttaaggcttccctgagattggtttccttatcattttctccaccgccgctgtcccattttctgatgagtttgcttttaatgatttatccaacagtttgtcttgcagaagaagaagaccattgagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcct

SEQ ID NO: 2278 - DNA, 4646 bp, Homo sapiens
  ENST00000495514
cctcctcctcctcctcgcacggtaatgggaggctcctaggcaggagaagcaaaagaaggaattgtttgcgagttcagtcatccaaaaagcttcttccatatggagggaccgggtgcgctgggcgcggcgtcccctgcgttgtcctcctgctgccgcccccgcggccgccgctttctgccgcggggaccctgagccccggcccgccggtgtcagccgccgcgcgcgcgcacagacacacacacagagacacacaaacacacacagaaaagacacacacgcgcacacacggcgcgcacaccctcacgcccgccacagccacaacacgcccgcacgcgccctccctctccggcccgcaacttctcggtcctcggctcctttgttgctccagccgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaccttcaaa

SEQ ID NO: 2279 - DNA, 703 bp, Homo sapiens
  ENST00000498710
aagaaggaattgtttgcgagttcagtcatccaaaaagcttcttccatatggagggaccgggtgcgctgggcgcggcgtcccctgcgttgtcctcctgctgccgcccccgcggccgccgctttctgccgcggggaccctgagccccggcccgccggtgtcagccgccgcgcgcgcgcacagacacacacacagagacacacaaacacacacagaaaagacacacacgcgcacacacggcgcgcacaccctcacgcccgccacagccacaacacgcccgcacgcgccctccctctccggcccgcaacttctcggtcctcggctcctttgttgctccagccgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaagtggatctccaggacttcaagttagatgtgcagcacgtgattgaagtggatgagggaaacacagcagtcattgcctgccacctgcctgagagccaccccaaagcccaggtccggtacagcgtcaaacaagag

SEQ ID NO: 2280 - DNA, 2173 bp, Homo sapiens
  ENST00000485230
aaaaagcttcttccatatggagggaccgggtgcgctgggcgcggcgtcccctgcgttgtcctcctgctgccgcccccgcggccgccgctttctgccgcggggaccctgagccccggcccgccggtgtcagccgccgcgcgcgcgcacagacacacacacagagacacacaaacacacacagaaaagacacacacgcgcacacacggcgcgcacaccctcacgcccgccacagccacaacacgcccgcacgcgccctccctctccggcccgcaacttctcggtcctcggctcctttgttgctccagccgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccagtgagtctgctcctttgcctccctgccatggtgcggtccctcctcatctctcccaccctgaagcccccaccattcatgctgcctcttgttactcttagcataaaatgggccttaactgcagaaatgtcaaatcagaacagtagctgcctagtaatgcccagtgatgggggacccttgtgcccttggaaaacctcactccaagtagaggctgtatctggagtgagtgtctacagagaggggaattggtcagtgcatggcagaacttgacatggcagaactgttccgtgggccccagagcagggccgtgccgtgccttcctacttggtcatcctgtggctgtaggtgcactgtcccaactgctcacacaccttccagtcccctccctccattctcaccacagttacagtcggagcagggagagacaggacaccaagagacatgggcagggccacgtgtagtctggacagagcccacccagcccagacttggcctcctgtctctctgtgaggggcaagcatagtccgaaggcctggattataaatattagaacataatgaaaaggaaactgtgtggcaaagggataaagggatacagagaaaagaaacaaggaagagatgaggtgacagtttggaccaaggaaaatgccaagagaagacttcacactaccttttttttttctggttttgccattcttttattcatgttgttacactcagtataggatagtttattaaaatcattatgtctgtagacattctatttgtgatatagaaattgtgttatttctgacctctattttttcctattatgtgacaaagaacataggtcctcagaccaacatgtggaaaccaagggccaaatggcttctaaggtccctcccaactgaataattctggtaaattccatttccatgtgctcactgacggatggtcctaataaccgctcttatttcttttatgcttgtgaaagtcatagtttttacaaaattacttgagggtgtattataaagattcaacagagcaaagtaaaggccaagtgacttgacatagtcatagctggaagaggagccttaccaagacaggtgtttctagttgccattatacttattctaccttatgaggacccattgtatgaggctagatggaagtgagtaaacagacgtcctacctttg

SEQ ID NO: 2281 - DNA, 561 bp, Homo sapiens
  ENST00000462425
gagctgcggccgaggctgggcgcgccgggcgccgggcgaagaagttggggcgaggcgggcagcgggggtcccgggggctgcagccgctacggggcccaggggcgccgcatctcgttccctgccgcagcggtctggccgggcgatggtggtttcgcctcagcggttcccagaagcttctcgggtggaagaaggatccagccagcctcccaaacttccaccgaaggttgacaccagcgccccggccccatgctccaggccgtggggggaacccgaggcgtggcggcaaatgcgtagagtcactcaacacgcactcggcctctttggaggtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcct

SEQ ID NO: 2282 - DNA, 4276 bp, Homo sapiens
  ENST00000273395
gtttctcatagttggcgtcttctaaaggaaaaacactaaaatgaggaactcagcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaagcaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaa

SEQ ID NO: 2283 - DNA, 544 bp, Homo sapiens
  ENST00000494687
actaaaatgaggaactcagcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaagtagaagaagtgggtgaggttttctcttcagtctgatagctctggcctattaggtcagccatttgttcatgttttgtgttaccacttagagatagtttttctcatcctcaagtattgggagtccaactttgagtggaatctggactaaacttcagagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttga

SEQ ID NO: 2284 - DNA, 1616 bp, Homo sapiens
  ENST00000471963
agcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgtaaggcccgggcccacctgctgggggatgggggatcactgatggaagggctcacaaagatggaaagggaggtagatacctggaggtgccacatccaagctccagttctgtgtgcactggctttggccagggggacagccaggggttctcagccagggattctctcccctctggccggcctcagggccagcatctcacagcacacagcaccaggcgactgcctgctgccacacctgcctgatgggaggtttccttcacggttactttgcgattgggatgggtcagaatgtgtgtgctgggacaggacggtgggtcttgtctcaagctcagcagcggacacagcatgtgcctagaacagatggccacgtgggaggcctccaggctgctgttctgccctatatgaggtccctgggcctgcactctctgcactgatgaggtgtgccctgcaccaccctctggtgagcttccgggaggcccacatgctctcaatgcacaggaaaacagcagctacctttctgtgcgcttgcctggatccctgccaattcaaaggagtgacatcttacacggagttaggcttagagttggcaccagagatggaatcactgtgaagctaatgaagttaaacttccatcgtctttcactcactgacagaagcctcaca

SEQ ID NO: 2285 - DNA, 1286 bp, Homo sapiens
  ENST00000484034
ttagagatagtttttctcatcctcaagtattgggagtccaactttgagtggaatctggactaaacttcagagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccagtgagtctgctcctttgcctccctgccatggtgcggtccctcctcatctctcccaccctgaagcccccaccattcatgctgcctcttgttactcttagcataaaatgggccttaactgcagaaatgtcaaatcagaacagtagctgcctagtaatgcccagtgatgggggacccttgtgcccttggaaaacctcactccaagtagaggctgtatctggagtgagtgtctacagagaggggaattggtcagtgcatggcagaacttgacatggcagaactgttccgtgggccccagagcagggccgtgccgtgccttcctacttggtcatcctgtggctgtaggtgcactgtcccaactgctcacacaccttccagtcccctccctccattctcaccacagttacagtcggagcagggagagacaggacaccaagagacatgggcagggccacgtgtagtctggacagagcccacccagcccagacttggcctcctgtctctctgtgaggggcaagcatagtccgaaggcctggattataaatattagaacataatgaaaaggaaactgtgtggcaaagggataaagggatacagagaaaagaaacaaggaagagatgaggtgacagtttggaccaaggaaaatgccaagagaagacttcacactaccttttttttttctggttttgccattcttttattcatgttgttacactcagtataggatagtttattaaaatcattatgtctgtagacattcta

SEQ ID NO: 2286 - DNA, 561 bp, Homo sapiens
  ENST00000477178
tttaatgacattgcaaaataggttctttttagtctctctccttcttcctctcccactcctcccttctggcctgctttcccctcctgcccacccccagatttctctctcctgtcttgactttgattttcagccctcatcccccagtctctttcatctcttccccaatcccagctttcttccactgctcaaatctgggtgtaaatcccacctcaactgaaaggaaaagaaagaaacaagatttaacaactaatgtgcttggcatctacaaagatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgcc

SEQ ID NO: 2287 - DNA, 5750 bp, Homo sapiens
  ENST00000466059
ctcaaggccaagtagaccttacttgacctgactccacagctcaaaatgtacaccttttaactgcttgagtccaggaggctaaggttgtagtgagccaagatcatgccactgcactctagcctgagtgacagagtgagactctgtctcaagaaaaaaaatatatatatatacctttaaaaatattctatagattttaagagtttttatcaactctttctggttatgaaaggaacatatgttcattatagaaaacttagagaatacagaaaactgttttcaaaaaggtaaaacacctaatccaaccactcagaactaactggagactaggggaagaagagcattaatccctgctgtccccagcagaaggttggcagcagcctctgggagaggcctgcctgtcccaccagggccaagggtttctcccactccatctggcacttgctaataagcagctcatacctgggtggcccagcagcaggcaggcaccaggcttggcaacagcacggctctcaggaggggccaccagggcaaagctcagcactgatggccatagctttacctgccaggaagccaaatgccacccgagttgctggggtgtccaggagctgtgactctgcctcctagctacagaatctgaacacccgtgaggcaccatcccagggcacctgtggaccaggagcagacagagcctaacaggcccctgatgtggaagaaaggatttcagtggcattcatggggaggacagtggttgaaagtcagaatattcctctccaagtagcagaaatgcaataatgaggcgattccgagtgatggctatgactggtgggaagatttgctcatcatttgggaagggagaatgatgggaagctccaaaatcaatttcctccttcctggaggcttgcaggaatgatctcatctctcatgtgtgcagcctgggcctctcaatccttacaatagccctgaggcagcatacattaagcctttttacaaatgaggaaactgtatcagagagattaattaacttgcccaagatcacacagctaatacccagcagacccagagtgtgagaccatggctgattccaaatcctgcttcctttctagcctcccttagctccctttaaagtataaaatgctcttctattgacctatgcactaagttgtggcagttagtcagtcagccagtctgttagctggttggttagttaccttttctctctggcactctgtcctgcttgttgcaaggttttatggggagaacggcatcttaggctttgtcttgtggggactcaggtggacatcagctcctagtgcctgcccagcctgttcctctccctccgtgcacctctcctttgtggaagctgcagagtgaagtattctggacccatcccatcttcccctggccctgccctttccacaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgtaaggcccgggcccacctgctgggggatgggggatcactgatggaagggctcacaaagatggaaagggaggtagatacctggaggtgccacatccaagctccagttctgtgtgcactggctttggccagggggacagccaggggttctcagccagggattctctcccctctggccggcctcagggccagcatctcacagcacacagcaccaggcgactgcctgctgccacacctgcctgatgggaggtttccttcacggttactttgcgattgggatgggtcagaatgtgtgtgctgggacaggacggtgggtcttgtctcaagctcagcagcggacacagcatgtgcctagaacagatggccacgtgggaggcctccaggctgctgttctgccctatatgaggtccctgggcctgcactctctgcactgatgaggtgtgccctgcaccaccctctggtgagcttccgggaggcccacatgctctcaatgcacaggaaaacagcagctacctttctgtgcgcttgcctggatccctgccaattcaaaggagtgacatcttacacggagttaggcttagagttggcaccagagatggaatcactgtgaagctaatgaagttaaacttccatcgtctttcactcactgacagaagcctcacaaggccctaactttgtatgtatcattttccattctttttggggcctccgaaactgtataaatttcaggttttagaaaacctgggtgtgtccctggttggcatataaagcggaatcacacatagtccccttgctccttgaaggttgctgaggaacggcacacattagagagtaaacaggcctttcagtgagttctctgcagtttgtccacagtgttgaaaaaagattacagctttcccagctgtgcacctgaggaagtacataggtgatttgcatttggggaccttgcaatatgagaaatgcatgtgtttaaacagtggattccattcagctcagccggaggccggctctgagatgctcactgagagacagttgggcctgagaaccatagggtggggttgagagcatggcagattcttgtttcccatctcatcttcagcctcacagcgcacatactgagtgcaagcagaaagaaatatctgtaccatttaaactgcctctacactccctcacctttctctctttgccagcacacagttaactgtgcatatgttatgttgatgctgctgttcttctgtgttatctcatttcttactcataacagctccctgcagaagcagtccttgtttctgataaggacaccaagccccaagggaattctgtagcacgccccactctacataggttgaaagacccggaatggctgtttgatcccatctccatgctctctgggactgcctcctgggcatgctctacaggacatcctggtccacacgccttctgtccttgccctccttgcccctccaggctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgtttttttttt

SEQ ID NO: 2288 - DNA, 4882 bp, Homo sapiens
  ENST00000479182
ggaggtagatacctggaggtgccacatccaagctccagttctgtgtgcactggctttggccagggggacagccaggggttctcagccagggattctctcccctctggccggcctcagggccagcatctcacagcacacagcaccaggcgactgcctgctgccacacctgcctgatgggaggtttccttcacggttactttgcgattgggatgggtcagaatgtgtgtgctgggacaggacggtgggtcttgtctcaagctcagcagcggacacagcatgtgcctagaacagatggccacgtgggaggcctccaggctgctgttctgccctatatgaggtccctgggcctgcactctctgcactgatgaggtgtgccctgcaccaccctctggtgagcttccgggaggcccacatgctctcaatgcacaggaaaacagcagctacctttctgtgcgcttgcctggatccctgccaattcaaaggagtgacatcttacacggagttaggcttagagttggcaccagagatggaatcactgtgaagctaatgaagttaaacttccatcgtctttcactcactgacagaagcctcacaaggccctaactttgtatgtatcattttccattctttttggggcctccgaaactgtataaatttcaggttttagaaaacctgggtgtgtccctggttggcatataaagcggaatcacacatagtccccttgctccttgaaggttgctgaggaacggcacacattagagagtaaacaggcctttcagtgagttctctgcagtttgtccacagtgttgaaaaaagattacagctttcccagctgtgcacctgaggaagtacataggtgatttgcatttggggaccttgcaatatgagaaatgcatgtgtttaaacagtggattccattcagctcagccggaggccggctctgagatgctcactgagagacagttgggcctgagaaccatagggtggggttgagagcatggcagattcttgtttcccatctcatcttcagcctcacagcgcacatactgagtgcaagcagaaagaaatatctgtaccatttaaactgcctctacactccctcacctttctctctttgccagcacacagttaactgtgcatatgttatgttgatgctgctgttcttctgtgttatctcatttcttactcataacagctccctgcagaagcagtccttgtttctgataaggacaccaagccccaagggaattctgtagcacgccccactctacataggttgaaagacccggaatggctgtttgatcccatctccatgctctctgggactgcctcctgggcatgctctacaggacatcctggtccacacgccttctgtccttgccctccttgcccctccaggctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaagcaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcaggtagcgcattcttgggtgtgggcggcaggtatgggacacccaggagggagtggctgggctgccttggggggcctcctccctcctagggtctcaggctgggctgctgggccaggctttctttagtcaggagcagatgctcctgttgttgagtgaagactggaaagttacctggactccccggcgtggccgtctcattactcttccttttgagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaa

SEQ ID NO: 2289 - DNA, 663 bp, Homo sapiens
  ENST00000497495
gggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccgtaagccgctagcagcagggacggacgcgcagtcaggactggaactgcctcagaggcctgttcccatggctgaatggggtcttgcttctccccagaagctcccgacaggcccaccatctccacggcctccgagacctcagtgtacgtgacctggattccccgtgggaatggtgggttcc

SEQ ID NO: 2290 - DNA, 573 bp, Homo sapiens
  ENST00000463971
accagcatgcctccatgttgctgtctgtggtgtttaccacagtcctaaagccttctgcctccctccagaagagcatccagagccatctcccctgcagctcagctctgacagtggcgggtgttcttgtgaggcctttgagaacttgctttggggaagggctgcccagaagacccctccaggtcctgggccttgaaaggccatgggagaatcagaaggtatttcccagctcctgagttcagtgagtgtccctctcaccaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagcc

SEQ ID NO: 2291 - DNA, 564 bp, Homo sapiens
  ENST00000488486
acgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaagaagaaaaaag

SEQ ID NO: 2292 - DNA, 317 bp, Homo sapiens
  ENST00000473008
ttcagcagcagagtgacaccagcagcctgctgaggcagacccatcttggcaatggatatgacccccaaagtcaccagatcacgagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgtttttttttt

SEQ ID NO: 2293 - DNA, 4278 bp, Homo sapiens
  ENST00000355385
gtttctcatagttggcgtcttctaaaggaaaaacactaaaatgaggaactcagcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaccttc

SEQ ID NO: 2294 - DNA, 3558 bp, Homo sapiens
  ENST00000361539
agcggggagcaagagaatttgaaaagagacatccgctccctctcacacgctgagggggaggcattcgcgtttccccaaatgagaaagaaccacaagaaatcatgaagtaaaaactttggaaagctgccactggagatgttgcacaaaaacctggaatcttttaggagtctcctcccagtcgttgaaggtttggggagcagctgatacagcaaggagggctcttgcaaggattcaagctccgagccctggaggagcagcacggagcgggagagcgtggcgagagaatgaagaaaccaatcgcccgggagaagcatgaggtggcagtgtggcactcggtttagagggcttcggccggcggtggccccatggacagccctgctggcactgggcctgcctggctgggtgttggctgtctcagccacggcggctgctgtggtccccgagcagcatgcctccgtagctggccagcatcccctggactggctgctcacagaccggggccccttccaccgcgctcaggagtatgctgacttcatggagcggtaccgccagggtttcaccaccaggtacaggatttatagggagtttgcccgttggaaggtgaacaacttggctctggaaaggaaggacttcttcagtttgccattgcctcttgccccagagtttatccggaacattcgcctccttggaaggagacccaatctgcaacaggttacagaaaatctgattaaaaagtacggcactcatttcttactttctgccacccttggaggagaagagtccctgaccatttttgtggacaagcagaaactgggaagaaagacagagacaacaggaggtgcctctataatcgggggcagtgggaacagcacagctgtgtccctggagaccctgcaccagctggccgcctcctacttcatcgacagagagagcacgctgcgacggctgcaccatatccagatagccacgggggccatcaaggtcaccgagaccaggaccggtcctctgggctgcagcaactatgacaatctggactcagtcagttctgtcttggtacagagtccagagaacaaagtacagttacttggccttcaggtgctgctgcctgagtatctgcgtgagcgctttgtagctgcagcactcagctacatcacatgcagctctgagggtgagctcgtctgcaaggagaatgactgctggtgcaagtgcagccccaccttccctgaatgcaactgccctgatgctgacatccaggccatggaggacagcctgctgcagatccaggactcctgggccactcacaaccggcagtttgaagagtcagaagagttccaggccctgctgaaaaggctgcccgatgaccggttcctgaactccacagctatctcccagttctgggccatggacaccagccttcagcaccgctaccagcagctgggagctggcttgaaagtgctgttcaaaaagacccatcggatcctacgccggctcttcaacctctgcaagcgctgccatcgccagcctcgcttccgcctgcccaaggagaggtccttgtcctactggtggaaccgaatccagtccctcctctactgtggggaaagcacctttcctggcactttcctggaacagagccacagctgcacctgcccctatgaccaatcttcctgccagggccccatcccatgtgccttgggcgaagggcccgcgtgtgcccactgtgctccagacaatagcacacgctgtgggagctgcaacccgggctatgtgctggcccaggggctgtgccggccagaggtggccgagtccctggaaaactttcttgggctggagacagacttgcaggacctggagctaaagtacctgctgcagaagcaggatagccgcattgaggtacactccatcttcatcagcaatgacatgcggctgggcagctggtttgacccttcctggaggaagcgcatgctgctcaccctgaagagcaacaagtacaagcctgggctggtgcacgtgatgttggccttgtccttgcagatctgtctcaccaagaacagcaccctggagcctgtcatggccatctacgtcaacccctttgggggcagccactctgagagctggttcatgcctgtgaatgagggcagctttcctgactgggaaaggactaacgtggatgcagctgcccagtgccaaaactggactatcaccttggggaataggtggaagactttctttgagacagttcatgtttacctacggagccgaatcaagtccctggatgacagctccaatgagacaatctactatgagcccctggagatgactgatccctctaagaatttgggttacatgaaaattaacaccttgcaggtctttggctacagcctgccctttgacccagatgctatccgggacttaattctccagttggactacccatatactcaaggttcccaggactctgcactcttgcagctcattgagctcagggaccgggtgaaccagctttctccacctggcaaagtccgacttgaccttttctcctgcttgctccggcatcggcttaagctggccaacaatgaggtgggcaggatccagtcctccctgagggctttcaattctaagctgccaaaccctgtggaatatgagaccggcaaactctgtagctaatgggcggcccacttcagcactgggcaaggaggggatccatgaatctggggtacaaagataatctaagccctcaccttagtgccaacagggtgtgctcccacgagactttcagcatccagtagatgggacctcgaggctcgagctgaagcaggcgagagagaaacagctactgcgtgcgtgcgcgcacgcatacacacacacacacacacactggcacagggaggctacaactaagcagcctcagatctgtaaagttgattggtgctttctaaaatgaatgcaattgaaagaaaggagccaaggaagagattaagaaaaagaaccagctgaaccatgaaacaaacaaaaatcctaaaagtgattcttgtcattcaagaaagcaagaggggacaacaatgggaggggtcggagctcttccttcccctctgtggagtcacttttgtattctttttaaccagatttcttaaaatgttgttgttttgtgaatcctgacattggttcttacttttgtatgctgcctcctctgtgccctcccagacgctgactgggaaacacaagaagtacaaccaacaggaaccagcgccaagggcaggcagcggcctccttgctcccctcccttactcctccctctgctgcctcctccccccaccaagtttcagggccctggattgttcccagttcccattgtggtcccttcagagctcctttccaacagcatctctctgtcgaagaaagaagctctgtcaagttagagagagacaatgtgtaggaaatgttcttttttaaaaaaaaataacaaaaacaaaacaaaactatttattttgtgattgttttccttgttaatctgctccaaccacctgaacatctaagtaaacatttatctggtttaatata

SEQ ID NO: 2295 - DNA, 2494 bp, Homo sapiens
  ENST00000478325
acttgagagagagaattgtgtctcccctatgaagatggattgcttgagacagagttcaatagaagatgttaaacagataagctgagggcagggggactgagctttggaagagggcctttcaggcagcgaggccgctggcctgtggctccctctgatgagcttcttctaaagatggtaagggctgggggaagagcttggcagcaggggctgcactctctctcagctgtgtctatcttggccaagggttttatgttcctattggtaggggattcgagagcagagagcgtcaccaatacactcgtgttgttcaccataggagaagagtccctgaccatttttgtggacaagcagaaactgggaagaaagacagagacaacaggaggtgcctctataatcgggggcagtgggaacagcacagctgtgtccctggagaccctgcaccagctggccgcctcctacttcatcgacagagagagcacgctgcgacggctgcaccatatccagatagccacgggggccatcaaggtcaccgagaccaggaccggtcctctgggctgcagcaactatgacaatctggactcagtcagttctgtcttggtacagagtccagagaacaaagtacagttacttggccttcaggtgctgctgcctgagtatctgcgtgagcgctttgtagctgcagcactcagctacatcacatgcagctctgagggtgagctcgtctgcaaggagaatgactgctggtgcaagtgcagccccaccttccctgaatgcaactgccctgatgctgacatccaggccatggaggacagcctgctgcagatccaggactcctgggccactcacaaccggcagtttgaagagtcagaagagttccaggccctgctgaaaaggctgcccgatgaccggttcctgaactccacagctatctcccagttctgggccatggacaccagccttcagcaccgctaccagcagctgggagctggcttgaaagtgctgttcaaaaagacccatcggatcctacgccggctcttcaacctctgcaagcgctgccatcgccagcctcgcttccgcctgcccaaggagaggtccttgtcctactggtggaaccgaatccagtccctcctctactgtggggaaagcacctttcctggcactttcctggaacagagccacagctgcacctgcccctatgaccaatcttcctgccagggccccatcccatgtgccttgggcgaagggcccgcgtgtgcccactgtgctccagacaatagcacacgctgtgggagctgcaacccgggctatgtgctggcccaggggctgtgccggccagaggtggccgagtccctggaaaactttcttgggctggagacagacttgcaggacctggagctaaagtacctgctgcagaagcaggatagccgcattgaggtacactccatcttcatcagcaatgacatgcggctgggcagctggtttgacccttcctggaggaagcgcatgctgctcaccctgaagagcaacaagtacaagcctgggctggtgcacgtgatgttggccttgtccttgcagatctgtctcaccaagaacagcaccctggagcctgtcatggccatctacgtcaacccctttgggggcagccactctgagagctggttcatgcctgtgaatgagggcagctttcctgactgggaaaggactaacgtggatgcagctgcccagtgccaaaactggactatcaccttggggaataggtggaagactttctttgagacagttcatgtttacctacggagccgaatcaagtccctggatgacagctccaatgagacaatctactatgagcccctggagatgactgatccctctaagaatttgggttacatgaaaattaacaccttgcaggtctttggctacagcctgccctttgacccagatgctatccgggacttaattctccagttggactacccatatactcaaggttcccaggactctgcactcttgcagctcattgagctcagggaccgggtgaaccagctttctccacctggcaaagtccgacttgaccttttctcctgcttgctccggcatcggcttaagctggccaacaatgaggtgggcaggatccagtcctccctgagggctttcaattctaagctgccaaaccctgtggaatatgagaccggcaaactctgtagctaatgggcggcccacttcagcactgggcaaggaggggatccatgaatctggggtacaaagataatctaagccctcaccttagtgccaacagggtgtgctcccacgagactttcagcatccagtagatgggacctcgaggctcgagctgaagcaggcgagagagaaacagctactgcgtgcgtgcgcgcacgcatacacacacacacacacacactggcacagggaggctacaactaagcagcctcagatctgtaaagttgattggtgctttctaaaatgaatgcaattg

SEQ ID NO: 2296 - DNA, 373 bp, Homo sapiens
  ENST00000460161
ggggaggagggagatgccccttcaaggcttttgcccttcctgagggagcagaaaaagccacgaagactcctcgtaaacaacttgagagagagaattgtgtctcccctatgaagatggattgcttgagacagagttcaatagaagatgttaaacagataagctgagggcagggggactgagctttggaagagggcctttcaggcagcgaggccgctggcctgtggctccctctgatgagcttcttctaaagatggagaagagtccctgaccatttttgtggacaagcagaaactgggaagaaagacagagacaacaggaggtgcctctataatcgggggcagtgggaacagcacagctgtgtccctggagaccc

SEQ ID NO: 2297 - DNA, 3142 bp, Homo sapiens
  ENST00000367462
atgactacagccttgctcactagttctctctttatctcgttgtcttcaacacatccttttacttctctttgcagatttatctgtattccacctcctgttctctggggttacacagcttctgcctttccccactgtatggggatgtgcagcctgtaaattttcactttgcttaaggatcaccacgaatcaccccccaccattccccacccccccatataaagcattttcacattctgctttcttgccttgggggttcgtggctctctgtgtaactggtttttacttggttacatgccaccaggaactgctgattattttaaagtcctactaccctgcagctcactactttaccttgatttggaagatcatggaatatctatttgaatcctggatgtatttttctcacagtcttcttgcttcctgaaatttcctctggtgttgagggaaagctgagagaatgaaggctctaaatccccagtggaagcatgatatggcgaagcagagctggtgctgaattgttctctctgatggctctatgggagtggatagcactgagtcttcattgctgggttttagcggttgctgctgtttcggatcagcatgccacaagccccttcgactggctcctctctgataagggacccttccatcgctcacaggaatacacagattttgtggacagaagccggcagggatttagcacaagatacaagatatacagggagtttggccgctggaaagtaaataaccttgcagttgagagaagaaatttccttggctctcctctgcctcttgcccctgaattcttccgcaacataagacttttgggacgtcgacctacccttcagcaaatcacagaaaaccttatcaagaaatatgggacacatttcttgctatctgctactctgggaggagaggagtcactcacaatttttgtggacaagcggaagttgagcaaacgagctgaaggaagtgattccaccaccaatagctcttcggtcactctggagacgctacatcagctagccgcttcttatttcattgacagggacagcacccttcggagacttcaccacattcaaattgcatccactgccataaaggtaacagaaacacggactggtcctcttggctgcagtaactatgacaacctagattctgtcagttctgttctggttcagagtcctgagaataagattcagttgcaagggcttcaagtacttctcccagactatcttcaggaacgttttgtacaagcagctttgagctacattgcttgcaattcagagggagagtttatctgcaaggaaaatgactgctggtgtcactgtggtcccaaatttccagaatgcaactgcccctccatggacattcaagccatggaagagaatcttcttcgaataactgaaacctggaaagcttacaacagtgactttgaggaatcagatgaattcaagttatttatgaaaaggctacctatgaattatttcctcaacacatctactataatgcatttgtggacaatggattctaattttcagcgccgttatgaacaactggagaacagcatgaaacaacttttcctaaaggcgcagaaaattgtacacaagctttttagccttagcaagaggtgtcataaacaacccctcatcagcctgccaagacaaagaacctcaacctactggcttactcgcatccagtcttttctctactgcaatgagaacggcctcctaggcagcttttcagaagagacgcactcgtgcacgtgtccgaatgaccaggtggtctgcaccgcgttcctgccctgcacagtgggagacgcctctgcctgcctgacatgcgcaccagacaaccgcacccgctgcggcacctgcaacaccggctacatgctcagccaggggctctgcaagcctgaagtcgccgagtccaccgatcactatattggctttgaaactgacctgcaagatctcgagatgaaatatctgctgcagaaaacggacagacgaatagaagtccatgccatttttatcagcaatgacatgcgcctcaatagctggtttgatccctcctggcgtaagcggatgctcctcaccttgaagagcaataagtacaagtcaagtctggtccatatgattttgggtctctctttacagatttgcttaactaaaaacagcaccttggagccagtgttggctgtttatgtcaatcccttcggaggcagccactctgagagctggtttatgcctgtgaatgaaaacagctttccagactgggagcggactaagttggacctacccctgcagtgttataactggacattaactctggggaacaaatggaagacattttttgagacagtacacatctacctgagaagtcgcatcaagtccaatggtcccaatggtaatgagagcatttactatgaacctctggagtttattgacccttcccggaacctgggctatatgaaaatcaataacattcaagtgtttggctacagcatgcactttgaccctgaagcaattcgggacctgattttgcagctggactacccctatactcagggatcccaggattcagcacttttgcaactactagagatcagagaccgtgtaaataaactctccccacctggtcagcgtcgtctagatcttttctcttgcttgcttcgtcatagactcaagctgtctactagtgaggtggtgaggatccaatctgctctgcaggcgtttaatgccaaattgccaaacacaatggattatgacacgaccaaattatgtagttaaccataaatgtcaagcacaacccaaaatcttgaaggagtttttacagtgcttttgtggaacagtttatgtttggaagagtaaatttaaattgtcttttcaatatctgtcttatatcagtcaataacattggatggcaatttacacacatgaacttgctgacaatgaatatattatacagcagttttggtttatgaatgacataaatactgacaccagtctagaagacattctactttttacaataaatttcatttgtaattttatatgttccgtggcaatgcttttgtgcattacatcctctagagggaacataaaaagataccaataaaattttgtagctgaacagttattaaaaa

SEQ ID NO: 2298 - DNA, 238 bp, Homo sapiens
  ENST00000463404
ggtcccaaatttccagaatgcaactgcccctccatggacattcaagccatggaagagaatcttcttcgaataactgaaacctggaaagcttacaacagtgactttgaggaatcaggcttgaaattcaaatcctgttatactctacatagacaataaaaattggaatggagttttaggttactttcaaaggctgattcaatgtaatgtgaaaaattaaacaaatgcaagtaaataactt

SEQ ID NO: 2299 - DNA, 729 bp, Homo sapiens
  ENST00000631494
ccggtcgtcctgcctgacaagccagtgccatcagagtccgtgacttcatttgaagaaaggagggcttcatataattcaattcaaacattctctttggaggactgctgttgttgcgcaagggtggagggaggaaaaaaaaaagaaaaagaaaaaaaaaactttcagtacagtcagatccagtaaggaacagacagtcagtatttaggtgttgagggaaagctgagagaatgaaggctctaaatccccagtggaagcatgatatggcgaagcagagctggtgctgaattgttctctctgatggctctatgggagtggatagcactgagtcttcattgctgggttttagcggttgctgctgtttcggatcagcatgccacaagccccttcgactggctcctctctgataagggacccttccatcgctcacaggaatacacagattttgtggacagaagccggcagggatttagcacaagatacaagatatacagggagtttggccgctggaaagtaaataaccttgcagttgagagaagaaatttccttggctctcctctgcctcttgcccctgaattcttccgcaacataagacttttgggacgtcgacctacccttcagcaaatcacagaaaaccttatcaagaaatatgggacacatttcttgctatctgctactctgggaggagaggagtcactcacaatttttgtggacaagcggaagttgagcaaa

SEQ ID NO: 2300 - DNA, 528 bp, Homo sapiens
  ENST00000445957
ctgatggctgttctcctagtccccaagagttgaaccggagaggcttttactttgcaccaggtcgagaacgtgatcagccctttagagaaggaacctccttgtaacaggaattctgctgggaaacgccgtgtaggcactacctccgaagataagatgcatgtttggagctgtgtaaaatgcccactggctgtttgaaagaaggaaaaggtgactagggttgcaaattaaccttagtatcacttaaaaatattctatctagtcaaatgtacgtaagcaaagaagagagcaccaggatataaaactgccacagcagcttggaagacagatgattcagattttggggactttcttttgcgtgttacatagatttgtttgtcatcatgcagttaagcaggtgttgagggaaagctgagagaatgaaggctctaaatccccagtggaagcatgatatggcgaagcagagctggtgctgaattgttctctctgatggctctatgggagtggatagcactgagtcttcattgctgg

SEQ ID NO: 2301 - DNA, 557 bp, Homo sapiens
  ENST00000633243
aattgtcttgagtcacaggcagcaggaacgccaaagaagtgggacctgggagggctgctgccgccgctgctgcatctaaccacggttccccgtccccttgcctaagcctcaccggcacagcgcccccgaaagcgcctagcgactcggcctcctccgcatcttcagcccttcgatcaccgcccgcaccccccaccccccaccgcctcgtgcaaatcgctgatgatttggtcatcgtaatgtgaccggtcgtagtggtttatttggggagtgggggaattggttgtgttgggcttccttactacgcctccctcagttgctgcaagtgaaaatgttcaagggaaatactagtgaaatgcactgatggaatactattaatcctaatgataatggtcccaacgcaggaactgctgattattttaaagtcctactaccctgcagctcactactttaccttgatttggaagatcatggaatatctatttgaatcctggatgtatttttctcacagtcttcttgcttcctgaaatttcctctggtaagttattctctttatctgt

SEQ ID NO: 2302 - DNA, 1795 bp, Homo sapiens
  ENST00000545507
cccgccagtgtagccacattcctgcccctttccagttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 2303 - DNA, 1605 bp, Homo sapiens
  ENST00000346916
agttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 2304 - DNA, 1974 bp, Homo sapiens
  ENST00000333511
gctttttatagcggccgcgggcggcggcggcagcggttggaggttgtaggaccggcgaggaataggaatcatggcggctgcgctgttcgtgctgctgggattcgcgctgctgggcacccacggagcctccggggctgccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccc

SEQ ID NO: 2305 - DNA, 611 bp, Homo sapiens
  ENST00000576925
atagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaagtgagtgcctgaccacgccatgccgccacctgccccttctcacggctctcttgccgccagcggcctgtggtccgtgagaacaaaagaccggtcggcaggcttgatccaggcggaagttagggaccagctccgcgcagacccccagagggaaaccccagggaggggtctgaggggcgtccttgtgaggcagggggctccagcagccctggcaggagtccccattgcttgctcctcactaggtcccgggcacgaaagggcgccacactgccaggtcccgggcacgtgtgcgggcctcccaggctctgtgctcctggcacaagaggg

SEQ ID NO: 2306 - DNA, 545 bp, Homo sapiens
  ENST00000573216
atagcggccgcgggcggcggcggcagcggttggaggttgtaggaccggcgaggaataggaatcatggcggctgcgctgttcgtgctgctgggattcgcgctgctgggcacccacggagcctccggggctgaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagct

SEQ ID NO: 2307 - DNA, 1616 bp, Homo sapiens
  ENST00000353555
gccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 2308 - DNA, 582 bp, Homo sapiens
  ENST00000572899
gcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacggtgagtcctgcagccaggggtaccgggcaccaccgactgtcgggagaagttgttggcctgaggcacccggcacatcccagagccctggccccctgctccctggaggggaacagccctcctgcgggaggccggggatgggggcgggcctgcggttccaggctcctctctctcaccctcctgtcagggcctcccagagtgaaggctgtgaagtcgtcagaacacatcaacgagggg

SEQ ID NO: 2309 - DNA, 545 bp, Homo sapiens
  ENST00000590218
agcggttggaggttgtaggaccggcgaggaataggaatcatggcggctgcgctgttcgtgctgctgggattcgcgctgctgggcacccacggagcctccggggctgccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacgtgagtggcgggcacctccctccccgcctccctcagtttccctcctgtgccgctcgcctcccggctcctgctcagtagaacccagacgcct

SEQ ID NO: 2310 - DNA, 689 bp, Homo sapiens
  ENST00000613627
gtaggaccggcgaggaataggaatcatggcggctgcgctgttcgtgctgctgggattcgcgctgctgggcacccacggagcctccggggctgtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcacca

SEQ ID NO: 2311 - DNA, 1329 bp, Homo sapiens
  ENST00000618006
gcgaggaataggaatcatggcggctgcgctgttcgtgctgctgggattcgcgctgctgggcacccacggagcctccggggctgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctcca

SEQ ID NO: 2312 - DNA, 960 bp, Homo sapiens
  ENST00000614867
ggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctcca

SEQ ID NO: 2313 - DNA, 559 bp, Homo sapiens
  ENST00000573784
gtgcatttgtgcaggagactgagaagggtttcttctgagcagaaagcttagcctggggcttactggccagagctgcctgcagcctgggaagcagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggagg

SEQ ID NO: 2314 - DNA, 570 bp, Homo sapiens
  ENST00000574970
gcatttgtgcaggagactgagaagggtttcttctgagcagaaagcttagcctggggcttactggccagagctgcctgcagcctgggaagcagccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacccggcacagtcttcactaccgtagaagaccttggctccaagatactcctcacctgctccttgaatgacagcgccacagaggtcacagggcaccgctggctgaaggggggcgtggtgctgaaggaggacgc

SEQ ID NO: 2315 - DNA, 544 bp, Homo sapiens
  ENST00000576984
gaaaccccacttttgctggggactgactcgtgaagaccacaaggtctgggcaacacagccttggcccgtgtggggtggacactgctgtttgctctgtgaattcgtgactgtgtttgcctctcctgaaacttgcttcaggggcgtctgcgggttggtggggcacagccgggtgggccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctga

SEQ ID NO: 2316 - DNA, 2155 bp, Homo sapiens
  ENST00000571735
ttcttctgcctcagcctcctgagtagctgggattacaggcatgagccaacatgcccagctaattttttgtatttttagaagagacggggtttcaccgtgttagccaggatggtctcgatctcccgacctcgagatccacccgccttggcctcccaaagtgctgggattacaggcgtgagcctccgcgcccggccaccaccgcgcccagctggctacgtttttagaaaagaatttccagtttgtgctggggctgctacaagagctcgatgccctggtccctgctcagggacgtgggtgggtgccttgtctgtccccacaccctggtcccagcctcgtgtgtctctgggcaggaacatcgccaggcggggcctctgggttcccagcgccttagcccagggcccgccagctgccagcgaagggtgccttcccgaagggggtgccttcccgaaggggcctcctcagcaggcgctgggctcttcccttcccggaggcgtggccagaagttccccttgggcctccggtcctcggggcgtaagggccacggtgtatttttgggatgaaaaccagtccttcccggggaggagccgcaggttcctgggggtcaggcaggcagcgcgggccgtgctcctccactctgctgaccgcgtctcgccgggccttgcagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctc

SEQ ID NO: 2317 - DNA, 769 bp, Homo sapiens
  ENST00000618112
ccggcccctcgtgccccaggaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccaggg

SEQ ID NO: 2318 - DNA, 15955 bp, Homo sapiens
  ENST00000296452
gagccgagctgggagatggcggcggcagcggcggcgccgagagtgtgagcaccgcccgggagccgccggcccgggcgcagcgcgaccccgaccccgcccgcccgcctgcccgccatgggcaacgaggtcagcctggagggcggcgctggcgacgggccgctgccgcccggcggcgccggccccggcccgggccccggccccggccccggcgcaggaaagccgccttcagcaccggccggtggcggacagctccccgcggcgggagcagcgcggtcgaccgcggtaccaccggtccctggccccggccccggccccggtcccggccctggcccgggcagcacttcccggagactggaccccaaggaacccctgggtaaccagagagcagcttccccaactccgaagcaggcttctgctaccactcctggccatgagagcccccgagagacaagggcacagggaccagcaggccaggaggctgatggtccccgcaggacgctgcaggtagacagcaggacacagagatcagggcggtccccctcagtgtcaccggacagaggcagcacccccacatcaccctactccgtccctcagatcgccccccttcccagcagcacgctgtgtcccatatgcaagacttcggacctcacgtcgacccccagccagccaaacttcaacacctgcacccagtgtcacaacaaggtctgcaaccagtgtgggttcaaccccaaccctcatctcacccaggtgaaggagtggctctgtctgaactgtcagatgcagagggctctgggaatggacatgaccactgcacctcgctccaagagccagcagcagctgcactccccagccctgtctcctgcccactccccggccaaacagcccctggggaagccagaccaagagagatctcggggcccaggaggaccacagcctgggtcccgccaggctgagacagccagggccacctcagtgccggggcctgcccaagcagctgcccctccagaggtggggagggtgtctcctcagccccctcaacccaccaagccttccacagctgagcccaggccacctgcaggagaggccccggccaaaagtgccaccgcagtgcccgctgggcttggtgccactgagcagacccaggagggcctcactggtaagctcttcggccttggcgcgtcactgctaacccaggcgagcaccctcatgtctgtgcagcccgaggctgacacccagggccagcctgcccccagcaaggggacacctaagatcgtcttcaatgatgccagcaaggaggctggcccaaaacccttgggctcagggcccgggcctgggccagcacctggagccaaaactgagcctggggctagaatgggtcctggatctggacctggagccctgccgaaaactgggggaacaaccagtccaaagcatggcagagcagaacatcaggcagcatcgaaggctgctgccaagccaaagaccatgccgaaggaaagggccatctgcccactgtgccaagccgagctcaacgtgggcagcaagagcccagccaactataacacatgcaccacctgcaggctccaggtgtgcaacctgtgtggcttcaacccaacaccccacctggtggagaaaacagagtggctctgtctgaactgccaaaccaagcggctactggagggcagcctaggagagccgacccccctgccgccgcccacctcacagcagccccctgtaggggcccctcaccgtgcatctggaacatcccctctgaagcagaaagggccacaggggctgggccagccttcaggccccctgcctgccaaggccagccctctatccaccaaggccagccctctgcccagcaaggccagcccccaggccaagcccctcagggcttctgaacccagcaagaccccaagcagtgtccaggaaaagaagacccgagtccccactaaagctgagcccatgccgaagccacctccagagactaccccaacccctgcgactcctaaagtaaagagtggggtgaggagggctgaacctgccacccctgtcgtcaaggctgttccagaagcccccaagggtggggaggcggaggacctggtgggcaagccttactctcaggatgcgtctcggagcccacagagcctcagtgacacaggctattcctctgacggcatctctagctcccagagtgagatcacaggagtcgtgcagcaggaggtggaacagctggacagtgcaggggtgacagggccacatccacccagcccctccgagatccacaaggtggggagcagcatgcggcctttgctgcaggcccagggcctggccccaagtgagcggagcaagccactctccagcggtactggcgaggagcagaagcagcggccccactccttgtccatcacgcctgaggcctttgactctgatgaggagctggaggatatcctggaggaagacgaagactctgctgagtggaggcgccggagagagcagcaggacactgccgagtcctcagacgactttggcagccaattgaggcacgactatgtggaggacagcagtgagggtggcctgtcccctcttccaccccagcccccagcccgggcagcagaactgactgatgaggatttcatgcgacggcagattctcgagatgagcgccgaggaagacaacctggaggaggatgacactgccacctccgggcgtggcctggccaaacatggcacccagaaaggtggccccagacccaggcctgagcctagccaagaaccagcagcactgcccaagaggcgcctgccccacaatgccaccacgggctatgaggagctgctccctgagggaggctcagcagaggctaccgatggcagtgggaccctgcagggtgggctccgtcgcttcaagaccattgagctcaacagcacgggaagttatggtcatgagttggacctgggccaaggcccagaccccagtctggaccgggagcctgagctggagatggagagcctaacgggctcccctgaggaccgctcccgtggtgagcactcctctacattgcctgcctccacacccagctacacctcgggcacctctcccacctctctgtcctccctagaggaggacagtgacagcagccccagccgcaggcagcgtctagaagaagcaaagcagcagcgcaaggcccggcaccgctcccacgggcccctgctacccaccatcgaggactcctcagaggaggaggagctgcgggaggaagaggagctgcttcgtgagcaagagaagatgcgggaggtggagcagcagcgcatccgcagcacggcccgcaagacccggcgggacaaggaagaactgcgggcccagcggaggcgagagcgctccaagacaccacccagtaacttgtcacccatcgaggatgcctccccgacggaggagctgaggcaggcggccgagatggaggagctacaccgctcctcctgctctgagtactcaccctcaccctcccttgactctgaggctgaggccttggatggtggccctagccggctttacaagtcaggcagtgagtacaacctgcccaccttcatgtccctctactcaccaaccgagacaccctccggcagctccaccactcccagttccggacggccgctcaagagcgctgaggaggcttatgaggagatgatgcgcaaagctgagctgctccagaggcagcaaggccaggcagcaggggcccggggaccccatggcggcccctctcagcccacaggcccccggggcctgggctccttcgaatatcaagacactacagaccgtgagtatggccaggctgctcagcctgccgcagagggcacgccagccagcctgggagcagccgtgtacgaagaaatccttcagacatcacagagcatagtccgcatgcggcaggcctcctcacgagacctggcttttgctgaggacaaaaagaaggagaagcagtttctaaatgctgagagtgcatacatggacccaatgaagcaaaatggtggcccccttacccctggtaccagtcccacccagctcgctgcccctgtgtccttctctacccccacctcctcagacagcagcgggggccgagttattcccgatgtccgtgtcactcagcattttgcaaaggagactcaggaccccctcaagctgcacagctctcctgcctcccccagctcagcctccaaggagataggcatgcccttttcccagggccctgggaccccagccaccacagctgtggctccttgtccagctgggctgccacgaggatatatgactccagcctccccagcaggctccgagcgtagtccttcaccatcttccacagcccacagctatggacacagcccaaccactgcaaactatgggtcccaaactgaggatctaccccaggcccccagtggccttgctgcagctggacgagctgctagagagaagcccttgagtgcgagtgacggtgagggtggcactcctcagccttcccgggcatattcctactttgcaagctccagcccacctctctccccgtcttccccctcagagagtcccacattctcccctggcaagatgggcccaagggccacagcagagttctctacacagacgccaagtccagcccctgcctcagacatgccacggagccctggtgcccccactccatcacctatggtagcccagggtacacaaacaccacatcgacccagcacgcctcgcctggtgtggcaggagtcctctcaagaggctccctttatggtcatcacgctggcatctgacgcctccagccagaccaggatggtacatgccagtgcctccacctccccgctctgctcacctactgaaacccagcccaccacccatggctacagccagacaacacctccgagtgtgtctcagctgcccccagagccacctgggccacctggctttccacgggtgcccagtgctggtgcagatgggcccctggcactatatggctggggtgccctccctgctgagaacatctccctgtgccggatctcctctgtccctgggacgtctagggttgagccaggccccaggacccctggcactgcagtggtagacctccgtacagctgtcaagcccactcccatcatcctcactgaccagggcatggacctcacctctcttgctgtggaagcgaggaagtatggtcttgccctggatccaatcccaggacggcagtcgaccgccgtgcagcccttggttatcaacctcaatgcccaggagcataccttccttgctactgccaccaccgtgagcatcaccatggcctcgtctgtgttcatggctcaacaaaagcagcctgtggtctatggagacccctaccagagccgccttgactttggccagggtgggggtagccctgtgtgcctggcccaggtcaaacaagtagagcaggctgtccagacagccccataccgaagtgggccccggggaagacccagggaggccaagtttgccagatataacctacccaaccaagtagctcctctggccagaagagacgttttgatcactcagatgggcaccgcccagagcattggcctcaagccaggcccagtgccagagccaggtgccgagccccaccgggccacccctgcagagctgcggtcacatgctctgccaggtgccaggaagccacacacagtggtggtgcagatgggagagggcacagcaggcactgtgaccacactgctcccagaggagcctgcgggtgccctggaccttaccgggatgaggcctgagagccagctggcatgctgtgacatggtctacaagctcccctttggcagcagctgcactggcaccttccacccggcccccagtgtgcctgagaagagcatggcagatgctgccccacctggccaaagcagcagccccttctatggtccccgggaccctgagcctcctgagcccccaacctaccgggcacagggggtggtggggcctgggccccatgaggagcagaggccctacccacaaggcctgcctggtaggctgtactcctccatgtctgacaccaatttggctgaggctggcctcaactaccatgcccagaggatcgggcagctcttccagggtcctggacgagactcggctatggacctcagctcactgaagcactcctacagcctgggctttgcggatggacgctacctagggcagggcttgcagtatggctcagtcacggacctgcgtcatcctacagaccttttggctcacccgcttcccatgcggcgctatagctcagtgtcgaacatctactcagaccacaggtacggcccacggggagatgcagttggcttccaggaggccagcctggcccagtacagtgccaccacagcccgtgaaatcagtcgcatgtgcgctgccctcaactccatggaccagtatggtgggcggcatggcagtggtggtggtggccctgaccttgtgcagtaccagccccagcacgggcccgggctcagtgctccacagagtctggttcccctcagacctggactccttggtaaccccacctttccagagggccacccaagtcctgggaacttggcccagtatgggcctgcagcaggccaaggaacagcagtcagacagctgctgccgtccacagccactgtacgtgcagctgatggcatgatctactcgactatcaataccccaattgctgcaacactgcccatcaccacccagcctgcctcagtcctgcggcccatggtgcgtggtggcatgtacaggccttacgcatctggtggaatcacagccgtgccactcaccagtctgacacgtgtgcccatgattgccccccgggtacctcttggacccacagggctgtaccgctatcctgcaccaagtagatttcccattgcttccagtgttccacctgcagaagggcctgtctatctggggaaacctgctgctgccaaggcccctggggctgggggcccttcaaggccagagatgccagtaggggctgcacgggaagagcctcttcccacaaccacccctgctgccatcaaggaggctgcaggagccccagctcctgccccactagctggccagaagccaccagcagatgctgctcctgggggtggcagtggggccctcagccggccagggttcgagaaagaggaagcatcacaggaggagaggcagcggaagcaacaggagcagctgctccagctagagcgggagcgggtggagttggagaagctgcgacaacttcggctgcaagaggagctagagcgggaacgtgtggagctgcagaggcaccgtgaggaggagcagctgctggtgcagcgggagttgcaggagctgcagaccatcaagcaccatgtgctgcagcagcagcaagaggaacgccaggctcaatttgcactgcagcgggaacagctagcgcagcagcgtctgcagctggagcagatccagcagctgcagcagcagctgcagcagcagctagaggagcagaagcagcggcagaaggctccctttcctgcagcctgtgaggcacctggccgagggcctcccctagcggctgctgagttggcccagaatggccagtattggcccccccttacacatgcagccttcattgccatggcagggcctgaaggacttgggcagcctcgtgagcctgtgctgcaccggggtctccccagctctgcctcagacatgtcactgcaaacggaggagcagtgggaggccagccgtagtggcatcaagaagcggcactccatgccacgcctgcgggatgcctgtgagctagagtctgggactgagccctgtgtggtcaggaggattgccgacagcagcgtgcagacagacgatgaggatggggagagccgctacctcttgagtcggcgacgccgggcacggcggagtgctgactgcagtgtgcagacggacgacgaagacagtgctgagtgggagcagccagtgcgccgccgcaggtctcgtcttccccgccactcagactcaggctctgacagcaagcacgatgccactgcctcatcatccagtgctgctgccactgtgagggccatgagcagcgtgggcatccagaccatcagtgactgctccgtgcagacggagcctgaccagctgcccagggtctctccagccatccacatcacagctgccaccgatcccaaggtggagatcgtcaggtacatatcggcgccagagaagactgggcgtggggagagcctggcctgccagacggagccagatgggcaggcccagggtgtagccgggccgcagcttgtagggccaactgccatcagcccctacctgcctggcatccagatcgtcaccccagggcctctgggcagatttgaaaaaaagaagccagatcccctggagattgggtaccaggcccacctgcctccggagtctctctcacagcttgtgagccgccagcctcccaagtcccctcaggtcctctactcaccagtctcacccctgtcccctcaccggctcctggacacctcctttgcttccagtgagaggctgaacaaagctcacgtgagtccccagaagcacttcacggctgacagcgctctccgccagcagacgctgcctcgccccatgaagaccctgcagcggtccctgtctgaccctaagcccctcagccccaccgccgaagagtctgccaaagagagattctccctctaccagcaccaggggggactgggtagccaggtgtcggcgttgccacccaacagcctggtccgcaaggtgaagcggacactgcccagcccccctccagaggaggctcaccttcccctggctggccaggcctccccacagctgtatgcagccagcctgctgcagcgagggctgacggggcccaccactgtccctgctaccaaggccagcctgctccgggagctggaccgggacctgcggctggtggagcatgagtccaccaaactgcgcaagaagcaggcagagctggatgaggaggagaaggagattgacgccaagctcaagtacctggagttgggtatcacacaacgcaaagagtctttggccaaagaccggggtggccgtgactacccacccttgcgtggtcttggcgagcatcgtgactacctatcggacagtgagctcaaccagctgcggctccagggctgcaccactcccgctggccagtttgtggacttccctgccactgccgctgctcctgccaccccctctggtcccactgccttccagcagccccgcttccagcctccagccccacagtattctgcaggcagtggtgggccaactcagaacggattcccagcccaccaggcccccacctaccctggccccagcacgtacccagctcctgcctttcctcctggtgccagttacccagctgagcctggcctgccaaaccagcaggctttccgccccacaggccactatgcaggccaaacacccatgccaaccacacagagcaccctttttccagtccccgctgatagccgtgccccactgcagaagccacgccagacatcgctagccgacttggagcagaaggtgcccaccaactatgaggtgatcgccagccccgttgtgcccatgtcttcagccccatctgaaaccagctacagtggcccagcagtgagcagcggctatgagcagggcaaggtccctgaggtgccccgggctggtgaccgtggcagtgtgagccagagcccagcccccacctacccctctgactcacactataccagtctggagcagaacgttcctcgaaactacgtaatgattgatgacatcagtgaactgaccaaggacagcacctctactgctcctgatagccaacggctggagcccctggggccaggcagcagtgggcgtccagggaaggagcctggagaaccaggtgtccttgacgggcccacactgccctgctgctatgccagaggagaagaggaatctgaggaggactcatacgatccccgcgggaagggtggccacctccggagcatggagagcaatggtcgaccagccagtacccactactatggtgacagtgactacaggcatggggctcgagtagagaagtatggtccagggcccatggggcccaagcatccctccaagagcctggctccagctgccatctcctcaaagcgcagcaagcaccggaagcagggcatggagcaaaagatatccaagttctcgcctattgaagaggccaaagacgtagagtcagacctggcgtcctaccccccacctgcagtcagcagcagcctggtctctcggggcaggaagttccaggatgaaatcacctatgggctcaagaagaacgtgtatgagcagcaaaaatactatgggatgtccagccgggacgcagtggaggacgaccgcatttatggcgggagcagccggtcccgggcaccttctgcatacagtggggagaagctgtccagccacgacttcagtggctggggcaaggggtacgaaagggaacgggaggctgtggagcgacttcaaaaagcgggccccaagccctcatccctaagtatggcccacagccgggtacgaccccccatgcggagccaggcctctgaagaggagagccccgtcagtcctttggggaggccccgccctgccggagggcccctccctcccggcggggatacctgcccacagttctgctccagccactccatgcctgatgtccaggaacatgtcaaggacggacctcgggcccacgcatataagcgtgaggagggctacatcctggatgattcccattgcgtggtttccgacagcgaagcgtatcacctgggccaggaggagacggactggtttgataagccccgggatgcccgctctgaccggttcaggcaccacgggggccatgcagtttcctcctcctcccagaagcgaggccctgccaggcacagctaccatgactacgatgaaccccctgaggagggcctgtggcctcatgatgagggtggcccaggccgccatgcctcagccaaggaacaccggcacggtgaccacgggcggcactcaggccgccacactggtgaggagccgggacggcgtgctgccaaaccacacgctcgggacctgggtcgccatgaggcccggccccactctcagcccagctctgctccagctatgccgaagaagggtcagcctgggtatcccagctctgctgagtactcacagccatcccgtgcttcatccgcataccatcatgcctctgacagcaagaagggctcccggcaagcccactccgggcccgctgcactgcagtcaaaggcagaaccccaggcgcagccgcagctgcaaggtcggcaggcagctccaggaccacagcagtcacagtcaccatcatccaggcaaataccctctggggcagcatcacgccagccacagacacagcagcagcagcaaggtcttgggctgcagcccccacagcaggctctgacacaggctcggctgcagcaacagagccagccaaccacccggggctcagcccctgctgccagccagcctgcagggaagcctcagccaggccccagcacagccacaggtcctcaaccagcaggaccgccacgggcagaacagacaaatggctctaaagggacagccaaagcaccgcaacaggggagggctcctcaggcccagccagcaccaggacctggacctgcaggtgtgaaggctggagccaggcctggaggaaccccaggggctcccgccggccagccaggtgccgatggggagagcgtgttctccaagatcctccctggcggggcagccgagcaagctggcaaactgacggaagctgtctctgcttttggcaaaaaattttcctcattctggtgaccatgcccagcatggctcttgaagaaatgaagagaggtatcattgctgtggaaaaatctctggagtcagaggcctgggcgcagctctggactctgcgtataacacatctacaatctggcaaacccttggcccaaagactcaccaggtgggacgtggcaggcaggcctcagttgaggacgtgatgttttctcacagcagctgcctgggtgaagcatctgctggacaagtcggaccactggccaggggacctttgattgtctttccagagatgctgctctctgcagggcaccaccttcaaggcacagcccttgttgggagggagaaccctctccagaaaccctgccaccatggtgtcttgccgtacttcccacagccgcctttttgcggcctggccggccaggcttcccgtgcgttatacacagagtttgggcacacactgccctccctccgagatgccagaagtttttccacagccttggagaggggctttgactgagggctgggggccctgggctccgtttccttcacattccagctggcccggatccctctgtggcacagggccctgcccgtcacatgccctctgggtgacatcggagcagacctccatgtggccaggggttgggagaactttacaaacattaggacctaacactgtctcatcgctgaaataagaggccatagcaccgaaaagcagcgtgggcgccggctgaggcttctcccagcccgtgggtggcagcgtgctagcacactgccaccatctcaaagccatccccctagccatcgtgagcatcccagcggcaccgccattgtctcaaccagccggctcctcgtctgtacacctggggatttcttttgatttcaagaacagccttaatcattccagtttgatttacgtgtatacctcataaacatttttcttttgtttctctctccccctttctctcttctcttggctcactcccttgcctctccccctccaccaccaccttgtgactgatggtttggtttcctctctgctctgcccctgctcagcacagggagaatgttgacttagaagcaatagggggcagcaggccaccaagagcacaaccccagggcgaggtctggggaggcctcccagcccgcctctgtttactgtgcaattccagtcgttcttaagccatcaccagtgggtgtactcagagcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgtataaggagttaattgcaaacatgcaattgagaaactggatagatacactcataaaacccccacccctccccaccccacccctgctcccattgtgtgtgtgaaattctcagtctgtggcatgtttgacctgtggcaggactcgctgctgccaggtgagtcaccgcctgtcctgcagtggagcatgcacagctcgcagcctctttgcacgatttcatccattttaaatgcttgaccctcttgcttggagttctttttgcctcagaacctctccttcaggagcacttctagctgacttctgcacaagctagtgaggacctgccagaattgttgcctgagcgtgccaggctgcagggcaggcagtaaaaggcccccacataccctgcagttttctctgtccaggacagcaggtaaaaaggaatccccagagcagacgcaatggtaggagcctgcacaggatgtgtgtgtatggacattctgaaggtttgctgtaggatatctgtctgtctgtcattttcccttcctaccccaaccctgagccagaggcatctgacagccctttcccagagggcaccacgcaagggcagagctgggcggcatccacagccagagaggcagaggcaagagcagagccaggctgtgcccgagggaccccagctcttgactgcacctgtttcatgcctctcctctgtggctaggaggctcaaaggactgtgagccaggagatctgggctggagctagggggtcaatggatgctcaggaagagctgggcctttggcacttgtggtgagaacagttgacagtggtcatctggaactgttcatataaacagtggcttcaagctaagtttcttgtgaagtttctcaatagcaaatcttacagaaggtcctgtgtgaccctctctgcatctgtccccaggacctatgctccctgctcacccccttctccaaagcccaagcgtcccgctgctcatcagcttttttaccattgagccaggagtgcggcaggcagtacctgcctgacccttcaaggcctgaccttcgtccagagtgctctggtttgcaccatgcatttctcaggggtccgcatttctcatgcttttctataagatctacacaccccttcagagagggctcctcgctcacctctggtagctatggatgggacaggaagctgccaacctttgtgttggacttaacacccttgcctttctgggacttggcctcaccccacccatggaatacctgcctcatcccaaagatcaggtatgggctgaatgcagccatctgagcaagggctgagggaagccatcacctaacacctctggccacccaggaccaggtctgtgtggggatgtgccttggagaccaaggcaatagtcctttccactacaggccaggggatgggacaagaagtagggaacaggcagggaaatgttaggaggtcagcctccagcaggcctagtctcaggctctaaagtactgacttttcagcaaatttcctttctggccaagccctctgagtttgaaattctgacatctgccactcctcatcccccactgtacccacaggatacatcatcgcccctctgtgaaggtggctggagcaggcctctggtccatggactgtccttcctggcccttgcatggatgcagttgtgactctggggacaatgcagccagaagctgagggaccagcacttggtgccttggaaagtagagagcaacagacacatctccaaatgggcaaggagtctctagcatgcagcccaggccttctccatacccctctccccagcatcatgagcaagggcattgcctcctctctctgctcacttcagggcccagtgcactcacttcacagtgacagccctcccctacaatccttgggcagagcatgtggtctgagggcccacagtgaaagaacagcagtggtggcaactatgccttgccttctggagcctgtagggagttttccaggcaggtcctttgccaggacagcatggtcctgccctgttgtcccgtctgctctcctcttacccacccccatgctgtaaatacttgtcatcatggactccaacagggttagagggacaggcctaatcaactgaaactcctcggagatgccatctctgtctccctgggtgccagcagccctgctgccatgtgcactggggtggcactggagagccatggcagtcgtgagatattgtatgtgtatgcacatgatcatgtgtgtatgtgcgtgcgtgcgtgcgtgtgtgtgtgtgtgtgtgtttctgcctcattcagtttctggggtcaaatcagctccttctctccaagtgcactaccctggagagtggtggccactcaataccttttcctctagctttcatgtcttgtttttgctttccccttcctcctccctctctccctttctttccttctctccttctttatttgaggggggaagagtgctgtacaaagtcaaacaaacaagtttacagttgtaagtgcaatgacccgagtcctccacatgaccttgtgaattgtgtgctgtccttctgtgctctgtgagaactcgtggtacttcagtgtccctccccctgtattgtgacaaggtaattctgtggtatcagaataaaaggacttgatataaacaa

SEQ ID NO: 2319 - DNA, 862 bp, Homo sapiens
  ENST00000467456
cccactgtgccaagccgagctcaacgtgggcagcaagagcccagccaactataacacatgcaccacctgcaggctccaggtgtgcaacctgtgtggcttcaacccaacaccccacctggtggagaaaacagagtggctctgtctgaactgccaaaccaagcggctactggagggcagcctaggagagccgacccccctgccgccgcccacctcacagcagccccctgtaggggcccctcaccgtgcatctggaacatcccctctgaagcagaaagggccacaggggctgggccagccttcaggccccctgcctgccaaggccagccctctatccaccaaggccagccctctgcccagcaaggccagcccccaggccaagcccctcagggcttctgaacccagcaagaccccaagcagtgtccaggaaaagaagacccgagtccccactaaagctgagcccatgccgaagccacctccagagactaccccaacccctgcgactcctaaagtaaagagtggggtgaggagggctgaacctgccacccctgtcgtcaaggctgttccagaagcccccaagggtggggaggcggaggtcagtcccattcacttcccagagaccctagctttcagacaggacagtctatggaaaggcttgcctccctgggtggctgaggctgtaggctcaggacaggtgccttggggccacacaggagggaagggacacagtagaaggaaagtctagatgaggttctggcacgcttggagactgtgggttttacactggtgctgtgtctggcaccttgtcagatgctttgctgggttttgataccctttgatctagtaaagtttctctttgaagacc

SEQ ID NO: 2320 - DNA, 7250 bp, Homo sapiens
  ENST00000265990
cagttgtgcgtgccgacgcccgcgtcagcaaagagcggagctgagggtacccggtttgaagtcgtgcgggtcggaggactgccgcctccgctaccgtcttggacccctgcttaccggccgccgcggggacgagctcgggtaggcggcagggcagatgcccgagggcctgcgctggaacgccccacgccgcaccggccgctcccctgtgctccgcggcctgggcctgcgccgctcagctctctggaaactagcgcctcagctgcgcggcgcgtaggtcgcggggagctccgaaccgccggcgcccggccatggcggtctccaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggatccacctcagaaaaagatggaatgcaccatactgtcaccaagcacagaggtataattacactctacaggcaccagaaagctgcctttgctatcacaagtaggcgaggtcctacccccaaagcagtaaaagctcaaatagcagatcttcctgcaggaagtagtggaaatattcttgttgaacttgatgaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttgatggaaaatccctcctggataagggagatagccctgctcaagaattggtgaattctctgcaggtttttgaaacagcagcagcttcaatggattctgagcttcatcccttgttggtccagcatttgccacatctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctgtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggcaggcattccagaccctccaaacatgtcagcagaattaatccaattgaaagccaaggagcgacactttttggagcaattgttagatgggaaaaaattggaaaattataaaattccagtaccaatcaatgctgaactcagaaaatatcagcaggatggtgtgaactggttagcatttcttaataagtataaacttcatggaattctgtgtgatgacatgggtttaggaaaaactttacagtccatctgcattctagcaggagatcattgtcatagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggttacagcaccaagtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgatttcctcatgccaggatttttgggtactgaacgccagtttgctgctcgatatggtaaacctatattagcaagtagggatgctcgaagctccagtcgagagcaagaagcaggtgttcttgctatggatgcgctgcaccgccaagtactaccgtttcttttgagaagaatgaaagaagatgttttgcaggatcttccacctaaaattattcaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaattgctgttggactgcggtttgggaaatggcagcacttccgagagtggcacagagtctgttgtggcccagcacaggatactgatattctgtcagctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgttaatgtgaaatggtttaaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgtaaaa

SEQ ID NO: 2321 - DNA, 2003 bp, Homo sapiens
  ENST00000471217
tgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagaggtaagtgtattaatgcaacaattatcaccaagtattaatagttggcatctttttccaatgtagggaagtaacgagtatgtgccgtgaagtaggaatgagaggtaaataagaggaagagatatgaaaagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaa

SEQ ID NO: 2322 - DNA, 522 bp, Homo sapiens
  ENST00000476401
ttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagtgagtgtacattaagtgtcaggtagtcatacatttacaagtctggctttcaaaggttatttaaccaacagaagattcctctgctgtctccatcagtccttccttccttcatcacactaattatagcctaaggaaaaattagagtaagcaaatacttctaattattttaaagctttaaaataggatttat

SEQ ID NO: 2323 - DNA, 6938 bp, Homo sapiens
  ENST00000544642
atgggagtattcaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggatccacctcagaaaaagatggaatgcaccatactgtcaccaagcacagaggtataattacactctacaggcaccagaaagctgcctttgctatcacaagtaggcgaggtcctacccccaaagcagtaaaagctcaaatagcagatcttcctgcaggaagtagtggaaatattcttgttgaacttgatgaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttgatggaaaatccctcctggataagggagatagccctgctcaagaattggtgaattctctgcaggtttttgaaacagcagcagcttcaatggattctgagcttcatcccttgttggtccagcatttgccacatctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctgtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggcaggcattccagaccctccaaacatgtcagcagaattaatccaattgaaagccaaggagcgacactttttggagcaattgttagatgggaaaaaattggaaaattataaaattccagtaccaatcaatgctgaactcagaaaatatcagcaggatggtgtgaactggttagcatttcttaataagtataaacttcatggaattctgtgtgatgacatgggtttaggaaaaactttacagtccatctgcattctagcaggagatcattgtcatagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggttacagcaccaagtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgatttcctcatgccaggatttttgggtactgaacgccagtttgctgctcgatatggtaaacctatattagcaagtagggatgctcgaagctccagtcgagagcaagaagcaggtgttcttgctatggatgcgctgcaccgccaagtactaccgtttcttttgagaagaatgaaagaagatgttttgcaggatcttccacctaaaattattcaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaattgctgttggactgcggtttgggaaatggcagcacttccgagagtggcacagagtctgttgtggcccagcacaggatactgatattctgtcagctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgttaatgtgaaatggtttaaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgt

SEQ ID NO: 2324 - DNA, 3297 bp, Homo sapiens
  ENST00000261721
agtcctgttacacctcccgcggccgcgcacagcggcaacccgggcgtgcgggggcgcgcgcggtcagggaggggcctgcggaggcgcgaggcccccggaagcgcctttcccggaaggcagggaggcagcgccggcctccggaggcggcctgggcgatggcggcggagttttgtccataacgtgggcaaccgcgcagctggaggatggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgtaagataagaaacagtttcttagagcagatagaaaaatgcttatttaaatctttgcatgatttaaaaacagattttccattttcttacaactttaagagaaaagaactgggtttaatggtttaaaaaaaagcacagctttttcaccttcatcttgtataatttcatagattggctgacttagggtctttcaatagtttgggaattgaaagattcttgttatatatagctagtttgggtttgtttttgttttaactattttgaaggttaggtgagatgggcaaataggcttaactattttgaaggttggatgaaaagagatgggtcagtattcctacagaattcttattaactcaaataactaaatttcagaaaattaagaagctgactttatatttggtggtttgaagtatcttgttgttagcatttgtaataatgctaaaaaaggcctaataaaatgcccaagaaaatattcagtgcatttatagagaaggatattttgtagtagtatagtaatgtgttatgtagtacagttttaaagctataaatggaattttgtgtaaattcacaaaaatgtgatataaacaggatctaagactggattccctgtcactaaactgcaccactatacctgtctctctgtgtgggggacactgctgatgattcccaagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgatatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatctaaagtaatatttcactttatattgtaaagaaggtaggtatattggtggctgaggtctcttgaaattgctaaagggaaatttttctatggtaatgctcttacggatataaacctcagttaaatggaattatctatgggatgtgtggttctggttaactaaaaattaaccagtaaacactctgtagtaaccattacagaaaatacttctgccttaaaaaatatgatatgccagagatgagttagtgtttcttgacgttggagaccttttaaatgcctcatctgttgtactgaacaattgaaactgcatgcagccataaaagggacaagaaacagaactgtttactaactttgggacatcccctggagtttttaaaaataaataaatatatatatatataaaaaaaac

SEQ ID NO: 2325 - DNA, 1467 bp, Homo sapiens
  ENST00000379403
atggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgt

SEQ ID NO: 2326 - DNA, 797 bp, Homo sapiens
  ENST00000559652
gaaatacgcagtcccagccttggaagcacactgtgtagaatttctcaccaaacatcttagggcagataatgcctttatgttacttactcagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcaggcaaatataaattatcaaaattgactgaagaagaaaagcctgaatagaccaattaccatggaaggaattaaaagttatcaaagaactgtcccttcacaaggtggtttttacagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgccc

SEQ ID NO: 2327 - DNA, 648 bp, Homo sapiens
  ENST00000558344
cattcatttgtttttgtttttgttgcatttgcttttgggttcttagtcatgaattctttacctaagccaatgtcttgaagagtttttttgatgctatcttctagaatttttatggtttcttagatttaagtctttgatccatcttgagttgatttttgtataaggtgagaaaggaggattcctggcatccatgaggaatagcatttattcctggatctaagttttgactaattaatgcttttaacattttaattaatgtgtttaacctcaaatggatttattgaaaccttaaaatatatgcaaaaattatatatgctaagatttttttcccctatttttatgttacgtcctctagatttgaatttacgttaagtgaattccaaagttaggaattgaaatcaaattcctttttttaggcttatgtttttatttccacaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaa

SEQ ID NO: 2328 - DNA, 608 bp, Homo sapiens
  ENST00000560015
ttacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagatggagtcgctctgtcactcaggctggagtgcagtggtgggatctctcacactgcaacctccgccttctgggttcaagcgatcctcccacctcagcctcctgagtaacctgtaaggcatgcatcaccacgcccagctaatctttttggatttttagtagagacggggtttcaccatgttgtccaggctggtctcgaactactgacctcaagtgatccacctgcttcagccttccaaagtgctggggttacaggggtgagccaccacgcccagctgttacatgatttttgtttggatcaccactgccagtgggctgagttct

SEQ ID NO: 2329 - DNA, 5767 bp, Homo sapiens
  ENST00000280758
ggttcggcaaggtttgcagccgccacggccgctgctgcgctccggtgcagggcaggctggcgccgagcgaaccagggccgggaactgggagccgggagccgggagccagctgcccgcggagctgcggcggcggcggcatctggggtggtctcagtcccacgaacaccgtggccggcgcccggtggctactgcgcccagcggggctcagggaagagcggtctagacactttttattttggaagaaaggggcaagccccggcgggagcttccttcccggcctggctcgctccccattgcgcccagctccggcccggactctggaagatgactccagggtctgctctgtatattccagcggcggcagttccgggaggcagccgaaagtactaacagttggtagcagcggctagtggaaaagtgagccaaggcggcgcggactcggctctccccgcgccccgcggcactcgctgctcctcgccgctccttccctttggctcccaggcggctgcagcatgaagtggcgcagcgatggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggtcaggctcgggctccggcccaggcccgagctcgggccctggtgcggcccccgcggcggataaagagcgggaggcgcccgggggaggagcggcgagcggcggcgcctgcagcgcagccagcagcgccagcgggggcagcagctgttgcgccccgccggccgccgcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggggtgctgtgcctaccagacagcctgaatcttcacagagacccacagcggtcaaacaagccaggggaactgcccatgttcagccagtcggagctgaggaccatcgagcagtctttgctggccacgcgcgtaggcagcatcgccgaattgagtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagggcatgactcccctgatgtatgcctgcgtccgtggggacgaggcgatggttcagatgctgctggatgccggagctgacctgaatgtggaggttgtcagtactcctcataaatatccatccgtccaccccgagacccgccattggacggctctgacttttgctgtgttgcatggacatattcctgtagttcagctcctcctggatgctggggccaaggtggaaggctcagtggagcatggcgaggagaactactcggaaacacccctccagctggcagctgctgtaggaaattttgagctggttagtttgctgttggagcgtggtgccgatcccctgataggaaccatgtacaggaatggaatttctacaaccccccagggtgatatgaactctttcagccaggctgcagcccacggacacaggaatgtgttccgcaaactgctcgcccagccagagaaggagaagagtgatatcctgtccctggaggagattctggccgaggggactgacctggcggagacagccccgccccccttgtgcgccagccgcaacagcaaggccaaactgagggccctgagggaggccatgtatcacagcgctgagcatggctacgtggatgtcacaattgatatcaggagcataggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatgaaacgcctagtgcagggaatgcttcccgggaactttccagttctcctgccgcattggctttacacaaacacagacaaattccacctggcacctgtttttggctgggccaaggagctgcctctactgctcccacgtgttcctgttgaaaaacaaaggactttccactggtctgcagatcagatcagctgggtccagagtttaatgggcaactggacaaccaagttaaccccaattgaaagcacccctaggaccattgaacacccactgccggggaccactgtccagtgaatggattgaggccttttaaaggtcactcaggttccaggttgacagttggaggacttcaccgtaccaaccctgaagagattgtattacacattaaggaccttggtagctgtgcttcagcaaacgtcaaccatggtagcaaattggtgaggctgtgaccaataatgaggaaataatctggcaaatttttaggggtgggaacttttttaaatgttcatttaaaaaaaaacaaaaacagggcagtcttgtagtttaaaatatatttctaaaagcttaacagttcgttttcaactaaattgtgtttagggatctgtgtttgagatttttctttatttcttttttttttttaaatagtaagtcacaggtccacactgtgtaaacatgcatctgataagatactgctgatattctaaacaagttgaaataatcttgccttagtgatcatgattacacaaaagaggtgcactgccaataagtatctctaattcaatagttgaaagcaacctgcatgctaatcgtggtttcggggtgagaataaaacacccccacataacatgcatttgcatgggcccgaacctgtgaaatgttacgtttgtgcttcatttttgccaaggtaaaaatgttccatcatttctagctaaaactccatttggtgaaaccaacatatccatttcttttcctagttacggatgatttggggatgcttttgcagaaatgtgttcatagatgatgctgaatgggggaggggggcagcacgtcagagaatttactattaatcccagagttttctctgtattctcagaagatgttaatagtttgttactagccagagagtatgactatgttagattatttttaaagatgaaacatgtatgataggatggattctttctgtattctgagagtgtacagtacaggattattataatgaaagtttatatcaacagggtttcgttggctctgccatatattataagcaaaagagattggtaaagtgccacagtattccagataacttttcagttgcggcctttcttctcgttctttaatttgaaacctagatacatgcagtaaaaactaggagaatgacttttacccttggggacagccaagttttgttgataaacctatttcctagcatgccttcaggaagttgtgccagaccctagattgtgaaggacccactgttcttctgttgtacgagctccctgaaccattgttcagaggaccaatgtcacatcgcttcatgggcatggcccatggagcatctgggtgatatctgtctacagtattggctcttctgcgaggctgatacacaaggcctctcttccacatgatcatttgcaaacctcccccagcccctaccatccaatgtggaaggaaaacaagaactgcctgaagaagagtccaagctacagatacacagcgtgtgcattgcggctgtcaccttcctcctcccacttctgtatcctcagagatgctgcgtggatgtttccttaacctcagctgacttccctgtgaatgtctaatgctagttcagggcctccaggcattgatttgtacagtggtaactcccaatgaggcttctgttatcatttggtgtgctttctctgtcattaaaagaaatgattttcccaggc

SEQ ID NO: 2330 - DNA, 3478 bp, Homo sapiens
  ENST00000420571
aaggtttgcagccgccacggccgctgctgcgctccggtgcagggcaggctggcgccgagcgaaccagggccgggaactgggagccgggagccgggagccagctgcccgcggagctgcggcggcggcggcatctggggtggtctcagtcccacgaacaccgtggccggcgcccggtggctactgcgcccagcggggctcagggaagagcggtctagacactttttattttggaagaaaggggcaagccccggcgggagcttccttcccggcctggctcgctccccattgcgcccagctccggcccggactctggaagatgactccagggtctgctctgtatattccagcggcggcagttccgggaggcagccgaaagtactaacagttggtagcagcggctagtggaaaagtgagccaaggcggcgcggactcggctctccccgcgccccgcggcactcgctgctcctcgccgctccttccctttggctcccaggcggctgcagcatgaagtggcgcagcgatggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggtcaggctcgggctccggcccaggcccgagctcgggccctggtgcggcccccgcggcggataaagagcgggaggcgcccgggggaggagcggcgagcggcggcgcctgcagcgcagccagcagcgccagcgggggcagcagctgttgcgccccgccggccgccgcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggggtgctgtgcctaccagacagcctgaatcttcacagagacccacagcggtcaaacaagccaggggaactgcccatgttcagccagtcggagctgaggaccatcgagcagtctttgctggccacgcgcgtaggcagcatcgccgaattgagtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagggcatgactcccctgatgtatgcctgcgtccgtggggacgaggcgatggttcagatgctgctggatgccggagctgacctgaatgtggaggttgtcagtactcctcataaatatccatccgtccaccccgagacccgccattggacggctctgacttttgctgtgttgcatggacatattcctgtagttcagctcctcctggatgctggggccaaggtggaaggctcagtggagcatggcgaggagaactactcggaaacacccctccagctggcagctgctgtaggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatga

SEQ ID NO: 2331 - DNA, 4614 bp, Homo sapiens
  ENST00000490090
atggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggtcaggctcgggctccggcccaggcccgagctcgggccctggtgcggcccccgcggcggataaagagcgggaggcgcccgggggaggagcggcgagcggcggcgcctgcagcgcagccagcagcgccagcgggggcagcagctgttgcgccccgccggccgccgcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggggtgctgtgcctaccagacagcctgaatcttcacagagacccacagcggtcaaacaagccaggggaactgcccatgttcagccagtcggagctgaggaccatcgagcagtctttgctggccacgcgcgtaggcagcatcgccgaattgagtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagggcatgactcccctgatgtatgcctgcgtccgtggggacgaggcgatggttcagatgctgctggatgccggagctgacctgaatgtggaggttgtcagtactcctcataaatatccatccgtccaccccgagacccgccattggacggctctgacttttgctgtgttgcatggacatattcctgtagttcagctcctcctggatgctggggccaaggtggaaggctcagtggagcatggcgaggagaactactcggaaacacccctccagctggcagctgctgtaggaaattttgagctggttagtttgctgttggagcgtggtgccgatcccctgataggaaccatgtacaggaatggaatttctacaaccccccagggtgatatgaactctttcagccaggctgcagcccacggacacaggaatgtgttccgcaaactgctcgcccagccagagaaggagaagagtgatatcctgtccctggaggagattctggccgaggggactgacctggcggagacagccccgccccccttgtgcgccagccgcaacagcaaggccaaactgagggccctgagggaggccatgtatcacagcgctgagcatggctacgtggatgtcacaattgatatcaggagcataggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggaggtaagggatccattgtggtgttggctatcataggtcccttgggtgagtggcacttctgtaaactcgggtcaccagcctgcatggaagtgtctggaaggacccgtgttgggttttcatttggatgaagacttggggctcttgttccttcctgactcctcagtcctcccaaacaggaagggcttctcatcagagaccttccctggcaggctggggtgctagtgcacttgcttgcctgactgcttttagtagccactgagtgaaacccaattttaactggcattggtggtaagggggcagggaagggaaggaatttgactgaaaagtctgaggctacagctgaggcgttaatagtgatatcatcaggaaatatcctagatgacgtcttctcccttgtcactaataaaagaattatatcccctaaaaacatccctcaaatcacaacactgtctgttcttccaagatatagaagctgagggcagattacagtctcctcctggctttcctcaaactgagcatcccacagtcatgaagcccacgcctgcttccttcactctccccagccccctgtctgcctcttgtaattcaactggttctagccccgcctgtctaggagtcttgtttctgcctgcttttgtccaaagccaagattttcccctgttccttgccaaaagtggaaatcttgttcattttcctaattgaaactgggagctttgaaccagaagccaaaaatcacccccaattaatcctcagcaaaagagccaggatctcggtcagttatctgacgtctggggggtacctggctgatgagagatgtcaggacacaatcaactgttcaagagcagacctcacacagtggttacaacacggaagctgggccagactagtctaaatccaggctccactgcttctgagctgtgtgactgtggacaagttatttaacctcatatcctcagcttccttacccataaaatggggataactatctacctcactgggttttttagaggatcttaaaatatgctaaggtgcttagaacagtgcctggcacacagtgatcgccaataggactatgtattcactgcaggcccacttatcctttcttcctattctgtgaaaccttccgtggtcactctctccccacccaaacacacacatggacacacagtgactctcttgtctccctggactactcctctgatggttttagtctcgaggatgtgggcttatttgtaaacaaaagtgcgctggtgtttacaactaatttttgtgtgtgtgtgaaacagtctcactctgcccccaggctggagtgcagtggtgcaatttcggctcactgcaacctctgcctcctgggttcacaccattctcctgcctcggcctcccgagtagctaggattacaggcacctgccaccacacccagctaatttgttgtatttttagtagagacggggtttcaccatgttggccagatggtctcgaactcctgacctcagcctcccaaagtgttgggattacaggcatgagccactgcacacggctgtttacaactaactgatcacaaccagttatggatttctgtattccttctccactcccactgcttcatttgtctagccttaacaaaa

SEQ ID NO: 2332 - DNA, 667 bp, Homo sapiens
  ENST00000550706
gcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgc

SEQ ID NO: 2333 - DNA, 723 bp, Homo sapiens
  ENST00000415943
gtaccggctgaatggttgaaagcttgcacggcctagacagtcgtaaaggggtgctgtgcctaccagacagcctgaatcttcacagagacccacagcggtcaaacaagccaggggaactgcccatgttcagccagtcggagctgaggaccatcgagcagtctttgctggccacgcgcgtaggcagcatcgccgaattgagtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagg

SEQ ID NO: 2334 - DNA, 4107 bp, Homo sapiens
  ENST00000357167
aaagagctccagaaagacgacagggacgaggctgcagatgggaagggagtgctagcggacaccttaggcttgggtccacaatcagggagccccaaatagaaataacacggggcgctgattggttttccgccgctccagaccctgcgcttggtgcttcaagtgactcatccttatgttcacatgatcgccgagagggataatattcccagatcagttacctcctagcctttcctagtcacattatccccaggctacagatgaggaaactgaggcccaaggattccagagagcctgccccggggtcaccggtgcggtccggatgtctccaaaggctctcccactactctggaattcagaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagggcatgactcccctgatgtatgcctgcgtccgtggggacgaggcgatggttcagatgctgctggatgccggagctgacctgaatgtggaggttgtcagtactcctcataaatatccatccgtccaccccgagacccgccattggacggctctgacttttgctgtgttgcatggacatattcctgtagttcagctcctcctggatgctggggccaaggtggaaggctcagtggagcatggcgaggagaactactcggaaacacccctccagctggcagctgctgtaggaaattttgagctggttagtttgctgttggagcgtggtgccgatcccctgataggaaccatgtacaggaatggaatttctacaaccccccagggtgatatgaactctttcagccaggctgcagcccacggacacaggaatgtgttccgcaaactgctcgcccagccagagaaggagaagagtgatatcctgtccctggaggagattctggccgaggggactgacctggcggagacagccccgccccccttgtgcgccagccgcaacagcaaggccaaactgagggccctgagggaggccatgtatcacagcgctgagcatggctacgtggatgtcacaattgatatcaggagcataggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatgaaacgcctagtgcagggaatgcttcccgggaactttccagttctcctgccgcattggctttacacaaacacagacaaattccacctggcacctgtttttggctgggccaaggagctgcctctactgctcccacgtgttcctgttgaaaaacaaaggactttccactggtctgcagatcagatcagctgggtccagagtttaatgggcaactggacaaccaagttaaccccaattgaaagcacccctaggaccattgaacacccactgccggggaccactgtccagtgaatggattgaggccttttaaaggtcactcaggttccaggttgacagttggaggacttcaccgtaccaaccctgaagagattgtattacacattaaggaccttggtagctgtgcttcagcaaacgtcaaccatggtagcaaattggtgaggctgtgaccaataatgaggaaataatctggcaaatttttaggggtgggaacttttttaaatgttcatttaaaaaaaaacaaaaacagggcagtcttgtagtttaaaatatatttctaaaagcttaacagttcgttttcaactaaattgtgtttagggatctgtgtttgagatttttctttatttcttttttttttttaaatagtaagtcacaggtccacactgtgtaaacatgcatctgataagatactgctgatattctaaacaagttgaaataatcttgccttagtgatcatgattacacaaaagaggtgcactgccaataagtatctctaattcaatagttgaaagcaacctgcatgctaatcgtggtttcggggtgagaataaaacacccccacataacatgcatttgcatgggcccgaacctgtgaaatgttacgtttgtgcttcatttttgccaaggtaaaaatgttccatcatttctagctaaaactccatttggtgaaaccaacatatccatttcttttcctagttacggatgatttggggatgcttttgcagaaatgtgttcatagatgatgctgaatgggggaggggggcagcacgtcagagaatttactattaatcccagagttttctctgtattctcagaagatgttaatagtttgttactagccagagagtatgactatgttagattatttttaaagatgaaacatgtatgataggatggattctttctgtattctgagagtgtacagtacaggattattataatgaaagtttatatcaacagggtttcgttggctctgccatatattataagcaaaagagattggtaaagtgccacagtattccagataacttttcagttgcggcctttcttctcgttctttaatttgaaacctagatacatgcagtaaaaactaggagaatgacttttacccttggggacagccaagttttgttgataaacctatttcctagcatgccttcaggaagttgtgccagaccctagattgtgaaggacccactgttcttctgttgtacgagctccctgaaccattgttcagaggaccaatgtcacatcgcttcatgggcatggcccatggagcatctgggtgatatctgtctacagtattggctcttctgcgaggctgatacacaaggcctctcttccacatgatcatttgcaaacctcccccagcccctaccatccaatgtggaaggaaaacaagaactgcctgaagaagagtccaagctacagatacacagcgtgtgcattgcggctgtcaccttcctcctcccacttctgtatcctcagagatgctgcgtggatgtttccttaacctcagctgacttccctgtgaatgtctaatgctagttcagggcctccaggcattgatttgtacagtggtaactcccaatgaggcttctgttatcatttggtgtgctttctctgtcattaaaagaaatgattttcccaggc

SEQ ID NO: 2335 - DNA, 811 bp, Homo sapiens
  ENST00000494235
agcgtttgtctcgttaatggagaacacagtcacaggatcaaaagggctaatttcaggataattctcctgaaatcctgctaatttcaggataattcactgcttccagaattttagagtactggtaaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatga

SEQ ID NO: 2336 - DNA, 1805 bp, Homo sapiens
  ENST00000375366
ggagggaggccaagcaggaaggggggtgccgtccccttgtgccggatcctatataaggaagagggatgtgagcagagtggtctgggcttcaccgtccctccagtggacttgggggctgagcataaagatgcctaggagaggctactccaagcctgggtcctggggcagcttctgggccatgctgaccttggtgggcctggtcacccatgcagcacagagagccgatgttggcggggaggcagctggcacctccatcaaccactcccaggcggtgctccagcgcttgcaggagctgctgcggcagggcaacgccagcgatgtggttctgcgggtgcaggctgcgggcaccgatgaggtccgggtattccacgcccaccgcctgctgctgggactgcacagtgagctgttcctggagctgctaagtaaccagagcgaggcggtgctgcaggagccacaggactgcgccgctgtcttcgacaagttcatcaggtacctgtactgcggggagctgaccgtgctgctgacccaggccatccccctgcacagactggccaccaagtacggcgtgtcctccctgcagcgcggcgtggccgactacatgcgcgcgcacctggcgggaggcgcgggcccggcggtgggctggtaccactacgcggtgggcaccggggacgaggccctgcgcgagagctgcctgcagttcctggcctggaacctgtcggccgtggcggccagcaccgagtggggcgccgtgagccccgagctgctctggcagctcctgcaacgctcggacctggtgctgcaggatgaactggagctgttccacgcgctggaggcctggctgggtcgcgcgcggccgccccctgccgtggccgagcgggcgctgcgcgccatacgctaccccatgatcccaccggcacagctgttccagctgcaggcgcgctcggcagccctggcgcgccacggccccgcggtggccgacctcctgctgcaggcctaccagttccacgccgcgtcgccgctgcactacgccaagttcttcgacgtcaacggcagcgccttcctgccccgcaactacctcgcgcccgcctggggcgccccgtgggtcatcaacaacccggcccgcgacgaccgcagcaccagcttccagacgcagctgggcccgagtggccacgacgcgggccgccgggtcacctggaacgtgctcttctcgccgcgctggctgcccgtcagcctgcggcccgtttacgcggacgccgcgggcactgctctgcccgccgcgcgcccggaggacggccgaccgcggctggtggtgacgccggccagcagcggcggcgacgcggcgggcgtgagcttccagaagacggtgctggtgggggcgcgccagcagggccgcctgctggtccgccacgcctacagcttccaccagagcagcgaggaggccggcgacttcctggcgcacgccgacctgcagcggcgcaactccgagtacctggttgagaacgccctgcacctgcacctcatcgtcaagcccgtataccacacccttatccggacccccaagtagcctcggggtctgggaataaaggcctggcctaggtggtccctgtgggtctgggaagggcaaggcgagcctggaggtggcaacaagcctggtcccctggatggccaggcgccggccaccctagggctggggtggagtccaggtgaggcgtggtagacaagatgcctggtttcaagagctgatttcacagctgacttgaaggaacgttcttggtcctgaataaaccgatgctcagagtggtaaa

SEQ ID NO: 2337 - DNA, 4680 bp, Homo sapiens
  ENST00000256015
acttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccagccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttcaa

SEQ ID NO: 2338 - DNA, 504 bp, Homo sapiens
  ENST00000552315
agcggttccccgcgaggctttaggggctggacggagggcgcccccttccccccagctggcaaaacggagaggagaagacaacacgcacaacaaagaaacttaagcccaccgaggcgggagctgcggtccgaggaccgtcggcggatttggggacaaaggagccgtggggctgggaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcc

SEQ ID NO: 2339 - DNA, 1275 bp, Homo sapiens
  ENST00000475157
aaaaacgctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctt

SEQ ID NO: 2340 - DNA, 2712 bp, Homo sapiens
  ENST00000290551
cagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgaggggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaa

SEQ ID NO: 2341 - DNA, 1275 bp, Homo sapiens; identical to SEQ ID NO: 2339
  ENST00000475157

SEQ ID NO: 2342 - DNA, 2712 bp, Homo sapiens; identical to SEQ ID NO: 2340
  ENST00000290551

SEQ ID NO: 2343 - DNA, 2895 bp, Homo sapiens
  ENST00000244513
atctcctaggctgaagctcctgaggggactcacatcagttatcttgctgctccagaagggtgggagatggcagttttcccaagctccggtctccccagatgtctgctcaccctcattctcctccagctgcccaaactggattcagctccctttgacgtgattggacccccggagcccatcctggccgttgtgggtgaggacgccgagctgccctgtcgcctgtctccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctgctctgggctctgaccctcacatcagtatgcaagttcaagagaatggagaaatctgtctggagtgcacctcagtgggatggtacccagagccccaggtgcagtggagaacttccaagggagagaagtttccatctacatcagagtccaggaatcctgatgaagaaggtttgttcactgtggctgcttcagtgatcatcagagacacttctgcgaaaaatgtgtcctgctacatccagaatctccttcttggccaggagaagaaagtagaaatatccataccagcttcctccctcccaaggctgactccctggatagtggctgtggctgtcatcctgatggttctaggacttctcaccattgggtccatatttttcacttggagactatacaacgaaagacccagagagaggaggaatgaattcagctctaaagagagactcctggaagaactcaaatggaaaaaggctaccttgcatgcagttgatgtgactctggacccagacacagctcatccccacctctttctttatgaggattcaaaatctgttcgactggaagattcacgtcagaaactgcctgagaaaacagagagatttgactcctggccctgtgtgttgggccgtgagaccttcacctcaggaaggcattactgggaggtggaggtgggagacaggactgactgggcaatcggcgtgtgtagggagaatgtgatgaagaaaggatttgaccccatgactcctgagaatgggttctgggctgtagagttgtatggaaatgggtactgggccctcactcctctccggacccctctcccattggcagggcccccacgccgggttgggattttcctagactatgaatcaggagacatctccttctacaacatgaatgatggatctgatatctatactttctccaatgtcactttctctggccccctccggcccttcttttgcctatggtctagcggtaaaaagcccctgaccatctgcccaattgctgatgggcctgagagggtcacagtcattgctaatgcccaggacctttctaaggagatcccattgtcccccatgggggaggactctgcccctagggatgcagacactctccattctaagctaatccctacccaacccagccaaggggcaccttaaggaatatctcagctcatctgttttcctttcctctaacccctctcctccatagccttctgaggcttcacctgctagctttacccagtctgtttcttcctgttgggtggcaattaattaatcctgtgaaggttacattgctgctgctagagagggtggggattgcaccttccaaatctgtttctgtaccaatatttgggggatggaggggtgactcaaactgcttctagtgttctcctaatcccttaagactagaacctataggaaactacttggagcaaactcaaaggacagattagggatcgagattgggtcaggttagcatggggttgtggttgaaatatcttggtatccaggataagggtatgtggaaaaacaggctttaggcaagtggaaaattcaaaatgtgctgtgaaaggacaatctcaggctgaaatcccataaaggaacttggagggaatattatgatggagggaagtgaggtgaatccaggcacatgatgaacacctggctcatccatagagttttcacagcctatatcgcaaattttctaagccacgtcctataggacagaggagactggccccacttctatgggtctgagctgtggaaaagggagagcagagaggaactgagatgagcagggatgaagggtcaggcagaaagcgtgatagaggagagaatttttgacaaaactcaaaagttgtttgcacagctgttctttgtaccctgttcctttctctgcgccctcctgtttctcccttgcctggaagtcattccaccctcaatttgttgatccacaagtttccagttgtcctcttctttttgttatagcatctctctatttcaaagacattcctagaagtcatccttcagtgatatcaccacttgctcagtcaccatctcaaccttatgtcacctcagccctcatctcaatgcccaaaccccttacacacaccttcagttagcttcaactgcctccgtttccacactgtgcacctttcactttccctacccagctttcctacatgctgcctctcctcagggtcccctgaatgctgcatcattgtgttcagtgcagctggactgattgcacctgtgtatttgcccctgagcactttcctttacacatgtggcttgtcttgccaatagactccaggcttataccttccatttccatcgtattctccagtttccaggatagacgttgctcatcgtctttacctaataaataagtttgtctgattgctg

SEQ ID NO: 2344 - DNA, 2266 bp, Homo sapiens
  ENST00000613186
ctgctccagaagggtgggagatggcagttttcccaagctccggtctccccagatgtctgctcaccctcattctcctccagctgcccaaactggattcagctccctttgacgtgattggacccccggagcccatcctggccgttgtgggtgaggacgccgagctgccctgtcgcctgtctccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctgctctgggctctgaccctcacatcagtatgcaagttcaagagaatggagaaatctgtctggagtgcacctcagtgggatggtacccagagccccaggtgcagtggagaacttccaagggagagaagtttccatctacatcagagtccaggaatcctgatgaagaaggtttgttcactgtggctgcttcagtgatcatcagagacacttctgcgaaaaatgtgtcctgctacatccagaatctccttcttggccaggagaagaaagtagaaatatccataccagcttcctccctcccaaggctgactccctggatagtggctgtggctgtcatcctgatggttctaggacttctcaccattgggtccatatttttcacttggagactatacaacgaaagacccagagagaggaggaatgaattcagctctaaagagagactcctggaagaactcaaatggaaaaaggctaccttgcatgcagttgatgtgactctggacccagacacagctcatccccacctctttctttatgaggattcaaaatctgttcgactggaagattcacgtcagaaactgcctgagaaaacagagagatttgactcctggccctgtgtgttgggccgtgagaccttcacctcaggaaggcattactgggaggtggaggtgggagacaggactgactgggcaatcggcgtgtgtagggagaatgtgatgaagaaaggatttgaccccatgactcctgagaatgggttctgggctgtagagttgtatggaaatgggtactgggccctcactcctctccggacccctctcccattggcagggcccccacgccgggttgggattttcctagactatgaatcaggagacatctccttctacaacatgaatgatggatctgatatctatactttctccaatgtcacagtcattgctaatgcccaggacctttctaaggagatcccattgtcccccatgggggaggactctgcccctagggatgcagacactctccattctaagctaatccctacccaacccagccaaggggcaccttaaggaatatctcagctcatctgttttcctttcctctaacccctctcctccatagccttctgaggcttcacctgctagctttacccagtctgtttcttcctgttgggtggcaattaattaatcctgtgaaggttacattgctgctgctagagagggtggggattgcaccttccaaatctgtttctgtaccaatatttgggggatggaggggtgactcaaactgcttctagtgttctcctaatcccttaagactagaacctataggaaactacttggagcaaactcaaaggacagattagggatcgagattgggtcaggttagcatggggttgtggttgaaatatcttggtatccaggataagggtatgtggaaaaacaggctttaggcaagtggaaaattcaaaatgtgctgtgaaaggacaatctcaggctgaaatcccataaaggaacttggagggaatattatgatggagggaagtgaggtgaatccaggcacatgatgaacacctggctcatccatagagttttcacagcctatatcgcaaattttctaagccacgtcctataggacagaggagactggccccacttctatgggtctgagctgtggaaaagggagagcagagaggaactgagatgagcagggatgaagggtcaggcagaaagcgtgatagaggagagaatttttgacaaaactcaaaagttgtttgcacagctgttctttgtaccctgttcctttctctgcgccctcctgtttctccctt

SEQ ID NO: 2345 - DNA, 583 bp, Homo sapiens
  ENST00000560120
gtcgaccgcgcgggaccgttaaatttgaaacttggcggctaggggtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagggcatttgaatatgaaattcgattttacactggaaatgaccctctggatgtttgggataggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagggcgtttatgcaatgagcctttggatatgtacagttacttgcacaaccaagggattggtgtttcacttgctcagttctatatctcatgggcagaagaatatgaagctagagaaaactttaggaaagcagatgcgatatttcagg

SEQ ID NO: 2346 - DNA, 3725 bp, Homo sapiens
  ENST00000287598
gaccgcgcgggaccgttaaatttgaaacttggcggctaggggtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgggcatttgaatatgaaattcgattttacactggaaatgaccctctggatgtttgggataggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagggcgtttatgcaatgagcctttggatatgtacagttacttgcacaaccaagggattggtgtttcacttgctcagttctatatctcatgggcagaagaatatgaagctagagaaaactttaggaaagcagatgcgatatttcaggaagggattcaacagaaggctgaaccactagaaagactacagtcccagcaccgacaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaaggctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacaggcctcgtggcaatacagcttcactgatagctgtacccgctgtgcttcccagtttcactccatatgtggaagagactgcacgacagccagttatgacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaactactcagcaagaaagaacaggtgatcagcaagaagagacgatgcctacaaaggagacaactaaactgcaaattgcttccgagtctcagaaaataccaggaatgactctatccagttctgtttgtcaagtaaactgttgtgccagagaaacttcacttgcggagaacatttggcaggaacaacctcattctaaaggtcccagtgtacctttctccatttttgatgagtttcttctttcagaaaagaagaataaaagtcctcctgcagatcccccacgagttttagctcaacgaagaccccttgcagttctcaaaacctcagaaagcatcacctcaaatgaagatgtgtctccagatgtttgtgatgaatttacaggaattgaacccttgagcgaggatgccattatcacaggcttcagaaatgtaacaatttgtcctaacccagaagacacttgtgactttgccagagcagctcgttttgtatccactccttttcatgagataatgtccttgaaggatctcccttctgatcctgagagactgttaccggaagaagatctagatgtaaagacctctgaggaccagcagacagcttgtggcactatctacagtcagactctcagcatcaagaagctgagcccaattattgaagacagtcgtgaagccacacactcctctggcttctctggttcttctgcctcggttgcaagcacctcctccatcaaatgtcttcaaattcctgagaaactagaacttactaatgagacttcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaatgaggattactgcattaaacgagaatacctaatatgtgaagattacaagttattctgggtggcgccaagaaactctgcagaattaacagtaataaaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggatcttctccaacacagtgaatatattacccatgaaataacagtgttgattatttataaccttttgacaatagtggagatgctacacaaagcagaaatagtccatggtgacttgagtccaaggtgtctgattctcagaaacagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtagacctgtttggtatagcagatttagcacatttactattgttcaaggaacacctacaggtcttctgggatgggtccttctggaaacttagccaaaatatttctgagctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttccctgtacttttcccatttgtaatttgtaaaatgttctcttatgatcaccatgtattttgtaaataataaaatagtatctgttaaatttgtgcttctaa

SEQ ID NO: 2347 - DNA, 526 bp, Homo sapiens
  ENST00000559414
aaatttgaaacttggcggctaggggtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgggcatttgaatatgaaattcgattttacactggaaatgaccctctggatgtttgggataggtatatcagctggacagagcagaactatcctcaaggggcgtttatgcaatgagcctttggatatgtacagttacttgcacaaccaagggattggtgtttcacttgctca

SEQ ID NO: 2348 - DNA, 580 bp, Homo sapiens
  ENST00000558715
gtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgagacggagtctcgctctttcggccaggctggagtgcagtggcacgatcttggctcactggaagctctgcctcctgggttcacgccaatctcctgcctcagcctcctgagtagctgggactacagggcatttgaatatgaaattcgattttacactggaaatgaccctctggatgtttgggataggtatatcagctggacagagcagaactatcctcaaggtgggaaggagagtaatatgtcaacgtt

SEQ ID NO: 2349 - DNA, 3628 bp, Homo sapiens
  ENST00000412359
gtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgggcatttgaatatgaaattcgattttacactggaaatgaccctctggatgtttgggataggtgggtctttttatttcacaaggacaatagaaacattaacaggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagggcgtttatgcaatgagcctttggatatgtacagttacttgcacaaccaagggattggtgtttcacttgctcagttctatatctcatgggcagaagaatatgaagctagagaaaactttaggaaagcagatgcgatatttcaggaagggattcaacagaaggctgaaccactagaaagactacagtcccagcaccgacaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaaggctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacaggcctcgtggcaatacagcttcactgatagctgtacccgctgtgcttcccagtttcactccatatgtggaagagactgcacgacagccagttatgacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaactactcagcaagaaagaacaggtgatcagcaagaagagacgatgcctacaaaggagacaactaaactgcaaattgcttccgagtctcagaaaataccaggaatgactctatccagttctgtttgtcaagtaaactgttgtgccagagaaacttcacttgcggagaacatttggcaggaacaacctcattctaaaggtcccagtgtacctttctccatttttgatgagtttcttctttcagaaaagaagaataaaagtcctcctgcagatcccccacgagttttagctcaacgaagaccccttgcagttctcaaaacctcagaaagcatcacctcaaatgaagatgtgtctccagatgtttgtgatgaatttacaggaattgaacccttgagcgaggatgccattatcacaggcttcagaaatgtaacaatttgtcctaacccagaagacacttgtgactttgccagagcagctcgttttgtatccactccttttcatgagataatgtccttgaaggatctcccttctgatcctgagagactgttaccggaagaagatctagatgtaaagacctctgaggaccagcagacagcttgtggcactatctacagtcagactctcagcatcaagaagctgagcccaattattgaagacagtcgtgaagccacacactcctctggcttctctggttcttctgcctcggttgcaagcacctcctccatcaaatgtcttcaaattcctgagaaactagaacttactaatgagacttcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaatgaggattactgcattaaacgagaatacctaatatgtgaagattacaagttattctgggtggcgccaagaaactctgcagaattaacagtaataaaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggatcttctccaacacagtgaatatattacccatgaaataacagtgttgattatttataaccttttgacaatagtggagatgctacacaaagcagaaatagtccatggtgacttgagtccaaggtgtctgattctcagaaacagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtagacctgtttggtatagcagatttagcacatttactattgttcaaggaacacctacaggtcttctgggatgggtccttctggaaacttagccaaaatatttctgagctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttc

SEQ ID NO: 2350 - DNA, 786 bp, Homo sapiens
  ENST00000559733
acaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaagggacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaactactcagcaagaaagaacaggtgatcagcaagaagagacgatgcctacaaaggagacaactaaactgcaaattgcttccgagtctcagaaaataccaggaatgactctatccagttctgtttgtcaagtaaactgttgtgccagagaaacttcacttgcggagaacatttggcaggaacaacctcattctaaaggtcccagtgtacctttctccatttttgatgagtttcttctttcagaaaagaagaataaaagtcctcctgcagatcccccacgagttttagctcaacgaagacccctt

SEQ ID NO: 2351 - DNA, 477 bp, Homo sapiens
  ENST00000559461
gctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaaggctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacagggtaaggactcttagatccagtgctttgctgacacaacaaagacttcacatttagggtagagaagtatttttaccatctcttttaattcctcttgaatattta

SEQ ID NO: 2352 - DNA, 633 bp, Homo sapiens
  ENST00000557848
gagaatgagctgcaagcaggcccttggaacacaggcaggtccttggaacacagggtaaggactcttagatccagtgctttgctgacacaacaaagacttcacatttagggtagagaagtatttttaccatctcttttaattcctcttgaatatttagccatggtctatatatgctgtctgagaacataaaactatggtaattttagttttcttcttcatctccagcctcgtggcaatacagcttcactgatagctgtacccgctgtgcttcccagtttcactccatatgtggaagagactgcacgacagccagttatagtcttgctctgttgcccagcaggctgaagtgcagtggcaccatctcagctcaccgcaacctcgacctcctggttcaacgggcatggcagcccacgtttgccatcccagcactttgggaggccaaggacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgg

SEQ ID NO: 2353 - DNA, 560 bp, Homo sapiens
  ENST00000559772
tgaatatttagccatggtctatatatgctgtctgagaacataaaactatggtaattttagttttcttcttcatctccagcctcgtggcaatacagcttcactgatagctgtacccgctgtgcttcccagtttcactccatatgtggaagagactgcacgacagccagttatgacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaactactcagcaagaaagaacaggtgatcagcaagaagagacgatgcctacaaaggagacaactaaactgcaaattg

SEQ ID NO: 2354 - DNA, 630 bp, Homo sapiens
  ENST00000558972
agtatatgcctggcactgctcagttgagtacaacagtactggtttagagtaggaataaaaattattggaaatgacttttgtggtacactcattttgtactgttagtggatgtctagggaaagagtacagtaaagctaatgttagaactagaaaatagcattttctggatgggagggacattgattttgtttatttaatgcaaacagcaagaagagacgatgcctacaaaggagacaactaaactgcaaattgcttccgagtctcagaaaataccaggaatgactctatccagttctgtttgtcaagtaaactgttgtgccagagaaacttcacttgcggagaacatttggcaggaacaacctcattctaaaggtcccagtgtacctttctccatttttgatgagtttcttctttcagaaaagaagaataaaagtcctcctgcagatcccccacgagttttagctcaacgaagaccccttgcagttctcaaaacctcagaaagcatcacctcaaatgaagatgtgtctccagatgtttgtgatgaatttacaggaattgaacccttgagcgaggatgccattatcacaggcttcagaaatgtaacaatttgtcctaacccagaagacactt

SEQ ID NO: 2355 - DNA, 439 bp, Homo sapiens
  ENST00000558151
cttttttttttaaagaccagctatgcagcttctttcatggcctatttttattatctccttctcttaaatctgggctcagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtagacctgtttggtatagcagatttagcacatttactattgttcaaggaacacctacaggtcttctgggatgggtccttctggaaacttagccaaaatatttctgagctaaaagatggtgaattgtggaataaattctttgtgcggattctgaatgccaatgatgaggccacagtgtctgttcttgg

SEQ ID NO: 2356 - DNA, 578 bp, Homo sapiens
  ENST00000450637
agaaagaaaaggtatcagtacagaaaagaagagtcagaaaataccgtgcaaaggcacattcagaacgtaaccaggatagctggagccaggattcaaggagagagggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactgg

SEQ ID NO: 2357 - DNA, 1059 bp, Homo sapiens
  ENST00000452206
gacttccggtgctggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatg

SEQ ID NO: 2358 - DNA, 1075 bp, Homo sapiens
  ENST00000410110
gacttccggtgctggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccaggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaa

SEQ ID NO: 2359 - DNA, 6875 bp, Homo sapiens
  ENST00000409600
gacttccggtgctggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacacttaggctttatacatcagtctttttttttttaaattccatgttaatacctagtggtattgtatgttgtgtgttcagatgtctttactgtatctgtataccattaagtaataattagactcccaaactgtaaaccacctacacagaattctggtgtagctaaaactacattaatatttctacaaccaattcattgcatgtttcttccatacaaagtgtgccattttatactgtgtatagtgaaaaagtgtgtcatcttccagaactacattattatctttgatcgtagtttgtttcttcataatgacactgtagtgtttacttagtagaacattatagtaagtggatatcacttgtgacagtaatagtgtaaagaaagggaatgctttataaaaagattgcagattccattccatataaaaagattccattctgaatcttaagtggtaattttagaattcaggtgccagtgccagcctatggcctcaagtatgtaattcttaatatagatgttaaattgtacttttaattatgattggataaatgttttttctaactgtcagtttctaaggctgtctccttagaaactaaatgagtttttagagctggttgtaagtttcttagccttactctgtgagttatagatgttatttcattctatatatagatgtttattccattcttatttaaaaaaaaaaacctccatataccaaaaatgctacaggatattttgaaatagcatattttagttaggggaaatgcatgtgaccaagaggttggacttctaattcagtttttcaaaagcttttttccattatcatacccccagcctttttaggcttttttttttttttttttgagacggagtctcgctctgtcaccaggctggagtgcagtggcgcgatcttggctcactgcaagttccgcctcccgggttcacgccattctcctgcctcagcctcccgagtagctgggactacaggcgcccgccaccatgcccgactaatttttttgtatttttagtagagacgaggtttcaccggattagcgaggatggtctcaatctcctgaccttgtgatccacccgcctcagcctcccaaagtgctgggattatgggcttgagccaccgcgcccagctagacttttttctaatagagtcccccataaattttattaccatagatacgctgtgtatgtactgtttctgtgctttgtacatgaaaagagtaaaatgtttttgtttttgttttggagacagtctcactctgttacctgggctggagtgcaatggcatgatctcagctcactgcaatctctgcctcctgggttcaagcgattctcttgcttcagcctcctgagtagctgggattacaggcggccaccaccacccctggctaatttttgtatttttagtagaggtttcaccacgttgatcaggctggtctcaaactcctgacctcgtggtctgcctgccttggcctcccaaagtgctgggattacaggcgtgagccaccatgcccaaccaattttttttttttaaatccttggtagtgattgacccccattgagaatgcatgctctaatattttttaaaagggaagaagacctagtgatagacctttgcattggcaggcatgtctttatgtttatacagtgaagtagtattttttctgtcagggtcaatagaaagtagacgaaattcattttcagccaatctttcaccagttgtgctttgttccttaccccaccacaggcaacagacaaagcatttcctgctgtctttcaaggtcttaacagattctttcttgattataaatgtattactaagtagaatcatttgggttctttctataaaaatcagtgaaaatcctctagatgaatgaattaaagttgtaggcataacactgataaacctctgctctcatactgaagtaggctgcttgcaggaactgacaactattggttggctttaaatgtaatgtagatgccaaagttttagtgtacagtgttacttaaattaccaaattacctttgtacaaatattcctcagatgctgtctacaggtgccatataaaataggttgataagtatttgcaaattctggtaaattgccttgctatgatttttcatgctcagtattagtcctctagtatcaatacgaagtttttctattccccagcctactaaggcctacaggttaaaataccaggaataaaaaggttttcagtggacttgatttaagtggaatctggatgatgtgacaagtacctttgtctttggagtaatgagtttataattggcttttgtccaaaaactcttaagtggattaatatctgaacaatcttagacataattatatgaaactggatcagaaaggctttctgactcctttctcttcacttttttctcccagcttaactagaggcaattaacagtcatttcaaatctaattatttttattttccagtgtacttatcatcctttcatctttatgctaggagtatagtctcagttcttaatgagttgatgggatgaagatatagatagatagatagatagatagatagatagatatttttttttttttttttttttttttttttttttttgagacagagtctcgctctgtcgcccaggcgggagtgcagtggcacaatctcggctcactgcaagctccgccttgggggttcacaccattctcctgtctcagcctcctagctgggattacaggcgcccaccaaccaagcccggctaaggtatttttaaatgtactcaatcactgtcattttagtaaccttgaatcagaacctcagttgttaaaggcttaactgcttgtggcaactactatagtgctctagtggggacagtggttaaaatctgcagaatcccttgctttgtcatcttatccagaaggactgatagcttgttaaactgtggtatgattagaatgttggtggttgtgtagtgcatttggggtgctacaacgttaatcaaatataattgagctgttctgtttccagtcagtgtaaccatttaaaaataccttggcaaaacaagctaggagctagttcatgctaatattcttaaggacaaaaatagtttacagcttttttttttttaatctgaaatcctgaaggctatgcttaaaagttagagataaacctgttggaaataagtgattcatttatagactgaagcctctatgacttcaaaaagatactcaacagtctctggcatttgaagaacaaaatattttctctgtaaatacacctcatttccattctagttaggagcaatggcgcccaggacggcacacagaatggagaaaactggatagctggtaactcatttagctcttggcactctaaaaaacctcaaatacagccatccaagccagtaattctattgctgcgttatttctgtgtttaactgtgaaacttgcttcttgtctgtacccttgaaatggaataaaatttcatgagactccttgttaatgtagagaaaa

SEQ ID NO: 2360 - DNA, 530 bp, Homo sapiens
  ENST00000464483
agttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctgggtaagtgtctgtggtttgtgggcttaataatttagaaaggtataatatatggagattatggagagtctagaatatgaactatttggcaaacttgttaaaatggagtgatttttttggttttgttgtattttggttttatccaactttagccccaggtggtacactggcagatgacatgatgcgtacagatgtctgcgt

SEQ ID NO: 2361 - DNA, 265 bp, Homo sapiens
  ENST00000460660
gaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagaggtaaatatttacgttttaatgtctctcttcaaacctccagaacatcttgtgtatcttgccttctctgacaggtacttgcatattactaaagcctcaaaagaagataccagaaagaaacttgaa

SEQ ID NO: 2362 - DNA, 2455 bp, Homo sapiens
  ENST00000409226
cgggtggggaggtggggtccgggtgtgcgccgcggcgctggctgcgaaggcagtggccgaggcgggctccctctgggccgtgcccggcctggctaacaaagccgccgcggcctctgttgtgtgatggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactg

SEQ ID NO: 2363 - DNA, 1473 bp, Homo sapiens
  ENST00000452790
accaccgctgcggccgccgcctccgccgctgctttcgctggagggcgggcggatgtacggggcgcctggggccccggcgcaaagcgcctcagtgactgtggtccgctcgttgcggcggccgccaccgcaggcgacaggggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgt

SEQ ID NO: 2364 - DNA, 557 bp, Homo sapiens
  ENST00000447069
agttttgcaggcctgagtggtgcaaggcggccgctgttgcggtcacaggcatgacctagggtaggatggtgctgcccgtaaccaggcttgtcagaagaaggggttcaccttttgacagtgttttagaattggcatacacattttggatgcctgctgactatggtgataatctctctttgcgttctgcgatgcttagtggtcgtggaagatggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcagg

SEQ ID NO: 2365 - DNA, 557 bp, Homo sapiens
  ENST00000419090
aatttgaagggtttcttgtagagagaaatgcacattttgacgtacatttgattcaagtgcagggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaac

SEQ ID NO: 2366 - DNA, 582 bp, Homo sapiens
  ENST00000463310
atgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaaggtaatttagattttgaattttgtaaataacacttaataaaaacccttataaacacaaaattatccaaatgatgag

SEQ ID NO: 2367 - DNA, 492 bp, Homo sapiens
  ENST00000491576
ttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaaggtattagaactatgccttgacaaaacaaactattctgctttcacgtggtgataagtgaactgtgactatatttttctaagaggatttatcacatcctgtggttcctagggatggcccaccagtaaataaacaaatagtaacattagctattgatgataatgctctgaattgggctgtggttcacaggttaaaaacaagaatatggcctggccaggcacaatgg

SEQ ID NO: 2368 - DNA, 779 bp, Homo sapiens
  ENST00000359893
tcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataattt

SEQ ID NO: 2369 - DNA, 2158 bp, Homo sapiens
  ENST00000303562
actcattcataaaacgcttgttataaaagcagtggctgcggcgcctcgtactccaaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 2370 - DNA, 796 bp, Homo sapiens
  ENST00000554617
ccaaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgtt

SEQ ID NO: 2371 - DNA, 596 bp, Homo sapiens
  ENST00000556324
aaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttctccggggaggtggcagaaagcggcaatcccccctcccccggcagcctggagcacggaggagggatgagggaggagggtgcagcgggcgggtg

SEQ ID NO: 2372 - DNA, 567 bp, Homo sapiens
  ENST00000554212
aaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaat

SEQ ID NO: 2373 - DNA, 1402 bp, Homo sapiens
  ENST00000535987
aaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaa

SEQ ID NO: 2374 - DNA, 629 bp, Homo sapiens
  ENST00000555242
gccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaaggggaaagttggagattgagcataagggcccttgagtaagactgtgtcttatgctttcctttatccctctgtatacaggagacag

SEQ ID NO: 2375 - DNA, 1496 bp, Homo sapiens
  ENST00000555686
gatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtag

SEQ ID NO: 2376 - DNA, 834 bp, Homo sapiens
  ENST00000555672
cggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatg

SEQ ID NO: 2377 - DNA, 249 bp, Homo sapiens
  ENST00000557139
cgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagaagaagaagagaaaaggagaatccgaagggaaaggaataagatggctgcagccaaatgccgcaaccggaggagggagctgactgatacactccaagcg

SEQ ID NO: 2378 - DNA, 1280 bp, Homo sapiens
  ENST00000555347
gcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaa

SEQ ID NO: 2379 - DNA, 2158 bp, Homo sapiens; identical to SEQ ID NO: 2369
  ENST00000303562

SEQ ID NO: 2380 - DNA, 796 bp, Homo sapiens; identical to SEQ ID NO: 2370
  ENST00000554617

SEQ ID NO: 2381 - DNA, 596 bp, Homo sapiens; identical to SEQ ID NO: 2371
  ENST00000556324

SEQ ID NO: 2382 - DNA, 567 bp, Homo sapiens; identical to SEQ ID NO: 2372
  ENST00000554212

SEQ ID NO: 2383 - DNA, 1402 bp, Homo sapiens; identical to SEQ ID NO: 2373
  ENST00000535987

SEQ ID NO: 2384 - DNA, 629 bp, Homo sapiens; identical to SEQ ID NO: 2374
  ENST00000555242

SEQ ID NO: 2385 - DNA, 1496 bp, Homo sapiens; identical to SEQ ID NO: 2375
  ENST00000555686

SEQ ID NO: 2386 - DNA, 834 bp, Homo sapiens; identical to SEQ ID NO: 2376
  ENST00000555672

SEQ ID NO: 2387 - DNA, 249 bp, Homo sapiens; identical to SEQ ID NO: 2377
  ENST00000557139

SEQ ID NO: 2388 - DNA, 1280 bp, Homo sapiens; identical to SEQ ID NO: 2378
  ENST00000555347

SEQ ID NO: 2389 - DNA, 5884 bp, Homo sapiens
  ENST00000327419
gaagcggcggcgaaggcggcggcggcggcggcggcggcggcagcagcgcggctcggtctctggtccattcactccacgctttctgcagccgccactgcagccgcgcggcgggggctccctccttgcagccagccggcggtccagcctggtgcctctgcaaaggaaaggggagcgtggagacgtgttcgaggtggtatcggcgaggatctctcgggcgccgctcactccttggtcgccttgcttgccagcagttgctcccttagtccttggctcgctcgcacaccccctcccgctacagggagcagttttgggtggcgtgggctccgtcctcttcttggctggtaggaacggtgtgcccaagaggggaagcctagtgggcctggcccctcccagccccgcgccaatgagtgccagggcgccgaaggagctgaggctggcgttgccgccgtgtctcctcaaccggacctttgcttcccccaacgccagcggcagcggcaacacgggtgcccgcggcccaggcgcagtaggcagcggcacctgcatcacgcaggtgggacagcagctcttccagtccttctcctccacgctggtgctgattgtcctggttaccctcatcttctgcctcatcgtgctgtccctctccactttccacatccacaagcgtaggatgaagaagcggaagatgcagagggctcaggaggaatatgagcgggatcactgcagcggcagccgcggtggcggggggctgccccgacctggcaggcaggccccaacccacgcaaaggaaacccggctggagaggcagccccgggactctcccttctgcgccccttccaacgcctcgtcgttgtcctcttcgtcccctggcctcccgtgccagggtccctgtgctcctccgcctccaccgccagcctccagtccccaaggagcacacgcagcttcctcctgtttggacacagctggcgagggccttttgcaaacggtggtactgtcctgatcgtctagcccctctcgttccccgtcctcgtttccagcatctttgccacccttgcttttttccttcttccttccttttccattttcctctggcccctctttcctcttcctggtttccttacctgccctccccttactcttgtttctcctccgccgaggcactgtgcggtatttgtaaatattgggcgaggaaagtctcggaagaagaaataacgctgataataatactttattaatatttatagtaattattataatactaataacacaatccaagcgcatgacaaatcacataatttctaactgtcaatggaggatgcatcttcccattccaccccgcgctcccctcaattaggaggagaaaccgcacaagctaccaaatatataaaaggcattgattcccggagcaaagggaggggagggggcccggtaatgtacatagctgtcaagttaagatttagtttccttccttcccctctgacccctaagctttcacttttcctttagcttccctttcctccccattcccaccctcagccgggctcaggcaatagtatattataaagaaaatgtctacattaagcaccaggactgcaagaggccatagagaatagtccccggaaagtgtttatgacaggtacccctcgccagtccgcccatttctcaccctttggttaaccattacattttccaggacagagcatttaatttactttttaaaatgaccctcgctggccgagcataagtacgttaaaatctttaaatgagttttttttaaaaagctaacgctttcattccctgccccgcccccacccgtacacctttgacttgtgacattttcaggatttacaaaggatctgggagctgtccagccaggtctggtgctgaagtcgcctcaccgttctgattacttcctctagttgtgaaggcagaggaggggctgttttggaaagtgactattctggcttttggttgggttctttcttctttttctacaatcgagttagcgtgtactattggttttcttattattaaacattgcataagttaccttttttgtaaaaaaaaaaaagtattaggtgatgtgcagtactgaaagtgcagtatctaaccaactagaacgtttgttttatttttagaacaagtgcacctttgttatatatttagtatattggtaccaaatacagaaaaaaactatagttctgtactatgtcctccaaactgtatattattgttcttaatttccagctgttgatataatggttaccactggatgagaaattcagtggtgcagacctggcttctgctgtttccagaagtgttcttttgtaccttattctgtagtagactgttataaaaagatgacacacacgctttattttttcttttgcaaataatagaaaaaacacaaccacagaaacaaacaaataatggatgtgcaagaatgccatctattaaaaacatggttaatatttaaacagtgcctgtagttctccctgcatgcagttaccacctggaggcagtggtgtgtgtgcttgcttgtactgtatgtggttggggatgagactggtggggatgttgggcaatttggatgataagacatgcgaatttcaagaaaagctagatccagtaattacttataggatacaaatgtttgcagcttgtttgtttagttacaaatctgtgcctgcagcaaaagaaaggctctctttctcagtctgtcctaacttcactgaacatacaaaaatactgagaaaaaaagaaagtgagaaaataagataaatattttattattttctaatgccagacaaggccatctatgttagaaatggaagtagtctatagttatttaccaccttgtttcctttggttgaatgacagaagaagccagaagcatattacaatattaattatatgcagtgacatctcttcttggaaatcaagcctttgacagctattcaaatttttggaaaatgtatgaatgaaagtgatctgcaaaaagctctaccaagagagtccttactatcctgcagggtgtaaggcaacagtgcccctatgagcatccctctcccaagcaactcattgttctaaattgtctacttggtccagacatatgtgctcttatccagaggaaacattacctctaatatttttggtcatctattaaattgcccaagctcagtttgcatcttttataaaaataatttaataaacttaattttaatcacccataagataatcacctttcctgaagcacagaagatcatcattgaagcatgccatcttgtaatattaggaagaccaggtataatctttgggtacaatatattaaacaatgaaccagtttttctccagtgccttagtcacttcctagtaataggtaaaagagtgcattaactccctcaggccactagggaatcctgtagtgcatcagagttctacactgtacatcagaatgactaaggcactgtgaagaagaaagtccattgatttttgtagcttaccctcatccagtggtagctctttaataccttattacagaatgacttttggacttgaaatttgaatagaatcagggtcccagaagggagcttcatcatttccaatgagctccaataagtgcatggatattactttctttcccttatttggtgcactttctacagcgaataatttcccattttattaaagcaataagatgttctgttgtgagcagtgctggataacgattccattttcttggtgctgaagctacgcatatgttcttgccttatgaatcatagtatattcaaggcatgcaataataatccccttccaaggagcagcctgtacactctgtgggggtaattatgaaattgtcctacatcatttctccccaaaggaatgcaaggagcaagagaaataaaagcattatgtatattgtaaaacaaatgatctcaatacctctcaacgtgggcacacatctgtaatacacttttattgtgcaactttaaatgtgtgtgcctttctccattaattgactgtagtttaatatttttaatagtgctctgtgtaaagatgatgcagtttgtgagtcagatttcatactgagcttaatatactcaaaacctaagcttccagtggtattacttgtgatttttttatgagatagagaattacatgaaattctagtaatccagtttccacacaaaattatttcaataagcacatatccaagcaatttgtacagaccttgtttaaagcactgcttcttatagggctcaattggcagtctcaggagcttgggatgctaccaacagggcatttaggttttcatttttatgaaacaaaaggcaatctggaaatagctaaatttattttaaggattttattcactgatgtcccgtcaaactaaatgcttcaaacccctatagctacagcttaacttctgcacttgctattcagtattaataaggtggcatgcttgattcttattgtttttaaaaatgagaaaatttggagagagaatactattatgtcaacggtacaagactctgaatcttgaagatgtagatggatataatatttagactttatatacacccatagatatgtatttatatatgcatacgttttgtataaatttacaattgactttttgtattctcttttctgtcattacaagaatgagatggaaaccaaaatagttgttccatcctcttacccaaagaggatactgaaaagtccggtatgtgcatgcacttgtttctctggggtcaaatctgaatgactttctctttaataatgaaaggggagagtcctggttagcttggaaaattggtaattagataagcttcctttcctaggttagtgactcaaatgtagcaatgataataaagttatgaccatatcaatgtggtctaaatatctagatggaaagcaaaaatatccagaagaggtttagggccatctagaccacaaacctggaacctggattgtggtttgatttttttcattttcaacctatatgttgtgtagaaatacaatttatatctgcatagctaaaggtaaagtgaaaatatgaccattatctgtttagtttgagaaatcatttttggataatatggataaattagctttaagaaacttctttgacatctgacttttccaccatttctatctgtatcaattgtattaattagataatggttaaatttttatttttttatcatgtagacatatgctttcatgcttttctgtgggtgaaagttgaacaattgctagctgatattatgtggaagttacaggttaaagtagaaccagaaattttaatataatctgatcaggttccttagtcccattcccatgtgaatctgaactttgaatttgaatctgaaaggcctacttatttgggccattttttgttggaacttgtgattgtaactcacagatgtttcagttcatattagaataaattgcccaatctataagagagtgtttaatcattggaatgaatgtaaatctgattctgatttggttatttatttgataacatttgagaaacagctaatgtggcttgacatcaatacttattaatgtcttcaacctaataatacaattggtgtcatgtatgaatgcttagctgacaataagaatttaatcaactttatttggagacaatgacttatcaaggaggtcctacccatttgtggtagggatatttcccttacagttgtgattacaagggattgtttctatagagagatgaacagcaacaacagtgacaatgatgacaacagaaaaactgacttttgaacttgagtatatccaatagatagaagaaaaaagatattagaattcatggaaattttgttttgcttttctatcaataaaagagttttcttgttaa

SEQ ID NO: 2390 - DNA, 5884 bp, Homo sapiens; identical to SEQ ID NO: 2389
  ENST00000327419

SEQ ID NO: 2391 - DNA, 8404 bp, Homo sapiens
  ENST00000261318
gggctgcgcccaaggctgccgggagcagactgggctgcgggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcaggaggagagggcagtgagagataggaatctcctccaggttcatgaccataatcagcccatcccgtggaaagtgcagtttaacttgggcaatagcagtcgtccgagcaatcagtgccgcaactccattcaagggaagcacctcatcacggatgaactcggctacgtttgcgagaggaaggatttgctggtaaatggctgctgtaatgtcaacgtccctagcacgaagcagtactgctgtgatggctgctggcccaacggctgctgcagcgcctatgagtactgtgtctcctgctgcctgcagcccaacaagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaaattatttttgttgttgttctgtgttctcgagtttcaggagttaaatcattcttccacccagatacaacattttctcttttaggacgtgaatattctctctaggcagttatttttgtttgtatttcgacagtatcaagcataggccctgaacgtgacctgttagccatatcctgacgtgtaaaattatctaaaaactcagacactcttccattctaatctaactgcacgatttctaacagtgggcaccatgtgcctgccctcaggttattttccagtggtagtcgaatgtgctcatataccctatggagagcactgttttagcagaaatctaatttctcttcctggaggaatttgttctcatttcttttgccacttaaaattaactgtgggctactcagccagggtacagtgggagcctcaggaaggtcagaggcaacctcctcccctgttctatcaatagaaacccaacgttgaggcaattcctaaacagacgcacctcgtagcttgctgtatgtgtttattctttattgctttcagctttggggctgtaacaggtacaaatatttggtttccctatgatttatagagaagaagaagaaacccagctttctatcagagcactgcaagagaagagtcttacacctgccctcagtgggagatgagaatggtcattatgacttagagaatgctacacgtgtaggttgctggtgtgtcctgaatccacaggcataaagcactccccatttttcctactgtaatgcagattctccggctcaaggtctagaatatttgatcctaagatcaagacatcatgcccttcgaatagtactgctctttgttttcaggagtcacgtgaacacacaactctcctatattcctcacgaacctcaggattgagcaaggtctttgtaatttttttggttcactttattgacctgggagcaaggtgctaattctgtggtcagtattcaatgtttttttcagtggagctttttctttgggccatatttgccttctaatacattcctgcaatatgtagtggtgatttcccttagcttcctcctactacctcttatactcatctccccaaattatttgcctcccttaaataagttttcctagaaggtaagctggtcaggcaatttgaaaaatattagatcccaagaaatctattccgtttgcattggacttctcggattccatgtgtttgcagcaggactacatcgaactctgatgtgccggattgtggcatgtctgcatgtctcatccatctattgtttttggtaactcagtttggaatttcagtgtctgtcttccctgggttgacattggaatcagcctctcctttgagcttattttaactcttgagcaacataacatagatttaatgtgaacagtttataccaaagggcagcctgtgcctgtttatggatcctctctgcctttgtacttgaagagcgcattttacatttccagtcctttcacagacaggagctccaaccttacgatggagaattaaacttgcttgtatttccactttgtggatgaggaactatgagaggtggagtgacttcctgggtccccgctgagacttagtgacagatcccagacaagaacttcatctctgactccaggtctagtcctcttccccctgtctcttgccaactccagccctgacaccgtgggcgtctcccctgagagcagatatatttcaattgtccaggccaaaagaggggcgaggcggcataaacacccaaattaggtggaggatccaaaagtcattttcatttggctgtggaatatgttttttgtatttcaatcagctaggggtgtgttcactgtttttggaaattcacagcgcttgagcctccataatgaagctgggctgcagagcacctggcacgtgctccaggctcccagctcccaacctaggacctctccctgccctccactctggttggtttgtggttccctcgaccgagggtttctagaatcagggaccttgtctaagttttgtttgcccagagcccagcgaagtgtgtgatacaccttgggagtttaggagatcacaaaagggatgaaaacacctttagaaaacatttcattggtggggcgtggtggcttatgcctgtaatcccagcactttggaaggctgaggcaggtggatcacctgaaggcaggagttcagaccagcctgaccaatatggtgaaaccccatctatactaaaaatacaaaaattagccgggtgtgggggcgtgtgcctgtttttgtgagactctgtctcaaaaaaaagaaaaaaatattgttaataagtgagtgttttcggctcaagggaattgagtcatacgttgcatctcccccagttctgcatcttatttgctgcgcttgctggagttgtaaagattggtcctaacagggaaagaagcacacaagagactgtgaaaagggctctgagacaagcaaggacaaaagagggagggaaataccttccacagggcctgggatctggcaatgctagagccttttttttttttttttttttttgcgatggagtcttgctctgttgctcaggctggagtgcaatggcgtgatctcagctcactgcaacctccccctcctgggttcaagcaattctcctgcctcagcctcctgagtagctgggatcacaggcgtacaccaccacacccagctaagtttttgtacttttagtagagacggggtttcaccatgttggccaggctggtcacggactcctgacctcagatgatctgcccgcctgagcctccgaaagtgctgggattacaggcgtgagccactgcgcccggcatggagctgctattgatgggtgagctccacagcttttgcagaagcagaggatatgacttgagagcagtgctgtcacctctcagcatgtccccaagcccaactggggcctcctggagatgcctcagtcggcactggccccaagggaatcgtggggaacagttgcacaatttgcaagtttctgagtgcagcttttcccatccttgggatcagcagataagttgtaaacacagggaggtactgcttattggatatacttttcataagtaggacagaattcttttgggactctagagttgggaactaccacttactagcggcgtggctgaggcagtcttcctcctctgtggctcaggcccttcatctgtgaaatggggtcacagcatctgcctctcagggtcactgtgaggtgtcgatgtgagcaaggcctgaggcttggcaagaagtcaatgtctgcaactcagcagggagcaatggcaggggcagtcaggggtcggctcggataggggtgggtgggctcctgaggttggaagggtaggaattacagagctcttgttactattgttgttactgtttttaaagatacgatatttcagataattcaggagcacgtaaggatgaaacttaggataacctaaaatcacacaacctagagagaagcgcatttttgtcttcccccattttctaggcaaaaatgaaagtactttgtcctcttgaaaaacaattctctaatgaatatcctatgttacatagaggcctgtgtaatgcatttgtgtggccacatggtgtcaatttcatgaatatacaataatattattaattccctgctgaggacattaactggtttccaaggctgcttgttgtttttgctactacaaataatgcattgatgataaatacttttacatacatggttgtatgtttatctgaactattttcaccaatatattcacctagtgtgtatggaagtgtccatttttgtcatacccctggtaaccctgtgatattatttttaaacattttgctaatggatctctgttcttgtttgaatgtatttaatttccagcagaatgagccccattccttattttgattggccatttatcatgtacatatggtgaaatgcctattcgtgacttagccaatgttgtttctttttcttactgattactacagtacatttttatatgaaagcagcctttgtccccttctcttgtttttcagccctgtgttagaaacaactaagctcacatattcacaaaccaacttttccagttcatctagggcagtggtgctcaacaggggcaattttgccccccagggaacatttggcaatgtctggagacatttttgtcacaggtggggaggagggcagtactgtgggcactcgtggagggaggccagggatggtgcccaacagcccccacgacacagaattacctggctggaagtgggagccgggtggagggagggaagccctgctctggggtcatatctccccgttagattgaacagaggagctcctggtagctgagtgctgacttcattatttttccccgcccttgctttctaccctgctgaagtgctgctgattaaattaccctgaaatccccacaggacacattacttcctcacaggtctctactagcccagcgctgcctcaaggaatggcattattcctttgccactgtgtcctcaccgcactcttggactccgccgaatgcagacaccctcctgtctgcagaaggatctggaggggtagaacgcttcccctctacgacggattgactccccagcacctcaccagcagttctttgaatggagtggctttggaggtgggagttgaggaagaaatgtgagcctgtcattacaggttctgtttagaaaactagtcattctactaaaaaggtatcacataagtaagtaggagcaataaaaacaaagaagatagtgggactccgagaagctttccccgcctctggcctgttagtctatcgttcgttgggcaaggctcttccagtgtgtgaccttttgcgtgttatcacagcatgagtgcagttttgtgtacaggcatccctatattcagcatgtatctgcaacatgccttacctcgtctgctgtcacagagcaaagtggagcaagtggtcgccgttggtctgcacctgagctgggagccgagtggtgacgtgcatatgggccgactgcgtctccacagaacctactcagtgatcttcctgtgtacgactcagtccctgatgttggagttgaactgtaggactgtctgtaaaatgaaagtgcagactttaatgtagtaaagagaatgacttgccagttacaaccaatgagcaaagcagttaattattcaaatattttaccaagagtccaggtttattttttctcaggactacacattctgtgagaccagagggaccaagacatatcactaccagaaatgtgttttcatcagcactgccagaggttttcatagggtagtttactcttggaatttttaaattcatacttttttttatgcaacgtggggtaggtaagcttctgatcactgtgcacccagattatcccaaaatcgaaagtggtgttggcagccgggtgtggtggctcacacctgtaatcccagcactttgggaggccaaggtgagaggattgcttgagcccagaattcgagaccagcctgagcaacatagggagaccctgtctctacaaaaaataaaaaaaaggagccaggcatggtagtgcacacctgtagtcccagctactcaggaggctgaggcgggaggatggcttgagtccaggaggtcaaggctgcagtgagccgtcattgcgccagtgtgctccaacctgggccacagagtgagaccctgtctgaggaggggaaaaaagtgttgtctaaatgagaaatcaccattatcagtaatttaagattccaggctatgttggtcacatctcactattcttttttttttgaaacggattctcgttccatcgcccaggctggagtgcagtggcacgatctgggctcgctgcaagctctgcctcctgggttcacgccattctcctgcctcagcctcccgagtagctgggactacaggcgcccgccaccgtgcccagctaatttttgtatttttagtagagacggggtttcaccgtgttagtagccaggatggtctcgatctcctgacctcgtgatccgcccacctcggcctcccaaagtgctgggattacaggagtgagccaccgcgcctggccacatctcactattcttaaggaagagagagagcgagagagagtgttgtcctgtcctgtggggattggggcattgtattaagttgtactgggggatgtcaagatagaaatgttgagtaagttactacctgaataaatatttgaccagttgatgctaatttgaatagtaaatgtgatgacattatatattctcagggatgtttccatacattggctctgtgtgtgcgtgtgtgtgtgtgtgtgtgtgtaacaaaagcagtatgaagtatgtgagcaatatcctaattttattgacaagagcactgaccttaatgaccttgagtaaattaccctctccggctttggtttcctcatttgtcaattaagggtgatggctagcgtatcttgcagatccaaattccaatttttgtaacaagccaaaagtccccctggctgttaaagcaagaccagagccctcgtatcccagcggctgggtcccaggcttttgattttcacaggacaaatgtagcccagccatctggagcccgtttttctccaaaccagggcttcctccttctctcttgcagatttcaactggggctcaccattttctgcctcttcctcctccagttttaaagagacaccatatccttctctgctgggaccaacttcccatgtactgctgccctgcacctgtgaaaacagctgctgtgttttctgtcataaaaatagctgccttttggcagagaagcacacaacggtactacgtttctgagccttaatgcagtgctcaattatttaggtgtgcttcacctgagatacacagagcatcttggaactcctactaagcagggcttctacaggcattgctcagctcagtaaaaggttttcctttctctgcttttgtgattaccaggcagaaaccttaaaatgtatgaacttacaaagaaattaaattgtgccaaattagattcccagcccctagagataaccactaattaaagttccgctggagcgttttgcctgtattttgtatataaacgtggattttgtatttgtatgtaaataaaggtaggaccctgctgtccata

SEQ ID NO: 2392 - DNA, 1371 bp, Homo sapiens
  ENST00000547630
ggtcacgtggggctgcgcccaaggctgccgggagcagactgggctgcgggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcaggctacgtttgcgagaggaaggatttgctggtaaatggctgctgtaatgtcaacgtccctagcacgaagcagtactgctgtgatggctgctggcccaacggctgctgcagcgcctatgagtactgtgtctcctgctgcctgcagcccaacaagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaaattatttttgttgttgttctgtgttctcgagtttcaggagttaaatcattcttccacccagatacaacattttctcttttaggacgtgaatattctctctaggcagttatttttgtttgtatttcgacagtatcaagcataggccctgaacgtgacctgttagccatatcctgacgtgtaaaattatctaaaaactcagacactcttccattctaatctaactgcacgatttctaacagtgggcaccatgtgcctgccctcaggttattt

SEQ ID NO: 2393 - DNA, 923 bp, Homo sapiens
  ENST00000548356
gttcccagttgcttgaatggttcttttgcagaatggatcattgtattgctaatcacatatctaatgaataagatacccagggtgttttggcatgcacgtgtgtgcacgcgtgtgtcctttcccctccctccttttctcctcctcttccccccttccctgtatcagcattctcttagtttaggagagatagccaaggtcaccttgtgctggcttaggtaatttattacaggcactaacttttgtttccatagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaaatta

SEQ ID NO: 2394 - DNA, 492 bp, Homo sapiens
  ENST00000547606
tcttcgggctgtcgctcgtctacttcctcagcagcaccttcaagcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatcca

SEQ ID NO: 2395 - DNA, 2633 bp, Homo sapiens
  ENST00000256319
cgtcaccgccgcgcagcgcgggcgcagagccctgccctcagctgaagggagtcttcttttttttttttttttccgctgtttttttctccgcccctaagaggttgactccaaacccggagttccgctaggtccaacaggagggcttacggcgtgagcggcgtacctggggagaggcttaggcagcggcaaccgctgattggcagtaaaggggttcactccccatctcctgctcgggcgaaaccgggacagccaatcagagagagtactgacggaaacggcccaatcctggagcagggctgagggagggggcggggacaaatggctcaggtggactccgggctggagctgtcctgggggagcttgtttgcggcagcggctgctgctgccactgctgtgctgggggcccggtcgccaggcaaaaagccctcccacgtttgaggggagtcatgagccgtttcctgaatgtgttaagaagttggctggttatggtgtccatcatagccatggggaacacgctgcagagcttccgagaccacacttttctctatgaaaagctctacactggcaagccaaaccttgtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctctgctctgatcagttcttgtactttgacctctgctaagacaagagcatggctgcctcctctgagccctaggagaatcacagctttatgcctgattgaatacaccatagtgagtaggacagctcatgacacaggtcagcctggctgcctccggctccttactgtcatttgctcattcctcttgtattcttgaagtcaaatcttcttttttctcaccttcaagagtctgcgttcacaactaaacactaagtgccctttcttatttcctcctaaagaagaaacagattcttgagagagcagagacaaaaaaatagaactaggcagcatagatgaaacaactgcatgacatgggaagaagacaactaaaccccgaggagaatgcactggaatggacagttgctcttaaaccctacccagagggcctcccccagctggaccctcatacacagtgtgtgtatccaaaaggccattgctatttcagcaaatatttgttgagtacttctccatgccggacacttgggaaagagaaatgaacgacacaggcaatgcccctgccctgtgggccttatattatagtcaaggtaacagaatcaacaagccaacacaaaaataaagaacttcaaatagggataagaactctaacaaacacaaggtattttggtcaagaaggaatgtggggtgggcagtggggaacgtaacttaaattagatcatcagaaagtcctccctgaggagatgggatttttttgttttttagagacagggtttcactctgtcacccaggctggagtgcagtggcacaatcacacctcactgcagcctcaacttcctgggctcaagtgatcctcctgcatcagcttcccaagtagctgggactacaagtgtgtaccaccacatccagctaacatttttgggggtgggaagagatggggtcttactatgttgtccaggctaagaggtgggatttgagctgagacttgaatgcccaggagttaaatgtcttaagatatggagcaggccgttagaaaggagggagcagcaactggaaggtagaatagtcttattcaaggaataagaactatgtaatcacagcatggtgaagagttaggaagtg

SEQ ID NO: 2396 - DNA, 7583 bp, Homo sapiens
  ENST00000555004
cgcgctcggggccctccgcctagtagagatctggagccagaagcccagagacagccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcagctgcccatgatggggggagctttcatggactcgcccaacgaggacttcagcaccgagtactccctgtttaactcctctgccaatgtccacgcggctgccaatggccagggccagccggaagatcctcctcggtcctccaacgacgccgtcttgctatggattgccatcatagctacgctggggaacatcgtggtggtgggcgtggtgtatgccttcaccttctgaggacggcacaccctgcaccaccatggggtgaggcttggcacgtagctctgacttgctgtcggcctttggcttctcctgtgttctagaaccaggagttttgaccaggggcggcggccgtccttctggaatttctccccagcagccctgatttcaaatatcccatgttgtggtcaagctgagtcagaagacatggaagtatgggcctcctgcccctagaggcatgacggggcaaggccttcagagggcagattggggatccttgaaactacattccaggaacatgggaccagatgagacagctagttaagtttaaaacatagacatgatttgatgatcgcttgctggtggtaaataatcactcgtgtgtcttgtttttatgcaaacttatcgaacctagggcgtggggtgctggggcaagagcagccctcagaacttcagtgttcctgacccaattctggtttcacattcagtcccttggccatctagtagggccattggatgttcctagtttgactttgaaatggcacctttgccaccagacacctggtcccttccaagacccaagtgcattgggagacccagggatggggggttactggtaataggtggggtttctgggggtgttgttggtggtttttatctcctggtcggactttctcttctttttaagaagaggagaggatgtctttaagagctagatgtgccaggcagtggactcttcaggccacccacgtgagaatgctgtttcttctctgaggaatcgtggaattttaaagatgaacaagattcacatccactgaattattcaacggatgggtcagaaaggggggtgatttgcctgtggtcaccaggcaggtttgtggaggagtcggaacagaaagatgtgtcctcactctcagctcactgagctctctgccccaactaagcacttccctgaggaggttgctgagaagctgccctcaggagaatgtccaggcatcttgaaggtgggtgcgagattggcaggctgctcagatacccgtcctttacattcagtgtggataccgtgcattctcctgaagctgtgaaagtgcttctgcccaagccacttccttaaattctgaaatatcagcatctggggtcctggcaagcaaggaagcttccaagtaaaaaccagagagaagggcacacttttctttcttcattaggaaatcttattgcacaggaaccacccccacccccaccccccacaccttcccaaggcagcatcccagtgcagatagagtgggaaaggtcccagaagggggctcactcacctctaggcccagagaggctttctcctcactttatacactgcaaaaacagaagaattgtgtcaataacaccctctgtagtggagaaacttaaaaagctggttaggaagctctcgtgtatatttagagacaattacaagaaagctggacttgccgctgtggtctcaggagaaatgagtgttcttgatgacaggcaaagggacatcttagttgtccagaagcggcactcttccctggaagccgccatgttaataggattactagcctggctccagacagtgcctgctcatggctgccagttcttaccgatcacatctgtcactgccaccgtatatcatctgccagtgcatcagcttaaggggaggtcacgagtgcaaaagaacctgacccttgacaatgagggagaagggacatggaccacctgtctggaattcctggaatcactggcagggtggaggctgggctggggagttagccgcggtgtgcgtgaatggctctgtctccagcaagtctctctccatcaaaccccaggtctgccccataagcaagatctttaacagatggatgtctccatgagaaaacccaaggcgagaagcccagagccatggcggggttgcttgacgtcctcatggagtcactctgccccacatgctcaaatcttccctctggccccacatccctaggagggcctgacccctgtaaagatacaggaggcagctccctggcctccaaatggcccatggagatggcagtcgggagacagggttctgtgtttgctgcggtgaagggaggagaaggcaggaggaaaaaggatggcttctagccctgaagaggactccagcatcccaggcaccgggtgcttctggctgcagttttccctatggaggcccctcagcctccagccctaacataaatgtcggttaaattcagttttcaagcctctctcccttttcagtgtcagagcagtagatggtccagggcattggaggcctcgaccactctgcattgcagattacagtgacttcctcggggttgccccatcttggtctcctgtggtttcttcatcagctttttttttaccagcatctctcaaataacaatgaagatagatatgcccattagtgtctgattaaggagcaaaggctggatttctggccacagcgagctgcactctccctcctgcctcagccggggtccgtcttagcagtttggaaaggggaaaaagatgccggtcctcactgcttaagttttgtgtccaggtgccactagacttgcatgcacactaactccttacaatcaccacacagcatcatcgccccagtgcacagatgaggaaccagaggctcagaggagtgaagttgccttcctgaggtcacacagcatgaaagtgatgagctaggatttgaatctgggaagttgggctctagagccagactgtactgccttctgccacactgtactgccttctgtgactgggtggcacctccagggcacatttacacaaggccctgaatctgcagaggctgtttctcaagatgcccgtcatggtgtggcctgggccagctctggcttccacaggtccctgactgtcctcagagtggaacatgctcaacctcccgcccactgctctctctctgcccagatttcaggggtgccggtccccaaggcctgcccccttctttaagactgaactcaagtctccttggaaggccccggtgaagctcccagagactggttttcttgggatgcaggcagaaggggaccctccctggccaacacccaggagcccagcagaagcacccacacgtagaaagaggctcactacagccagaagtgcagagtcagagtcctgggaccatcttgttctgcaaggtgaccccaggctccccaggacaggggagagggatcgtcctcattcagactctagctggggcctctgtactggcttctccctgggtggggttgcctgttacatagctgtgcctcagagaaagggtcctgcattttctggaatgttctctgtgcttacccctctgtgtgcccctccattgctcctctacaagcaattaggtgattcaaaagagcaacttaggctgggtgcagtgactcacacccgtaatcccggcactttgggaggccgaggcgggcagggacaggagttcaagaccagcctggccaacatggtgaaaccctgtctctacaaaaaatacaaaaattaaccagacattgtggcatgtgcctgtaatcccagctactcaggaggctgacacaggagaattgcttgaaccaggaggcggaggctgcagtgagctgagattgtgccactgcactccagcctgggcaacagaacgagactctgtctcaaaaaaaaaaaaaaagaaaagaaaaaaaaaaagagcaacttactgctttgtgaggttgtgagtggccaccactgaaggtctttgagaagaggccagacgccgctgtagccaggcctgtcttaagaggacttgtgcttccagggacccaggcaggatgatggcgcagctcttcctactccaagccaatgctgtccttcccctttcccatgaaatcaaggtcaagaggcaaataagactccctgctccactctaccccccagagagaaatgattctcgctcctttcagatcccccaggatctgagggagaaaggatgggaggaggggcagcagcatttcgctggaaaggcagcagatgcttttccagccccggttcagctggaaggcttggaggctggccagaccactctggcgtctcctgaagtgggtccctggagaccgaagaggctcagtggagtctgtctgttgtcagcactgctgcctgatccctgcaagacaaatggcactttccttcttcagaagcatcatctgccttcattattagcagtaatattattcccagttattattcttaccggtgccagttttgcacatctttttgttgctctatttgtgtctcatttacttctcaaattgcccctgggggcaggaatgaggatgcagagagatgcacgttaattactgtcgcatttttctgtggagaaaactgaggccagggctgaacgctcacagctaaggagctgtgattcagacccagttctgtcagctctagaggcaccctgcatcatgcccaccagggtgatccccctgggatggaccatctcgggatatgaggcctcggaggctggggttgagatttggtcctgaagagcttatagccagattgccacattcaagtgtaagtccaggaaaggggcaggcggcagtgcacagggatttatcagttccagaacctcacagtgataagaggctttagagagcatctaatcgagacctttaatttttcggggagagcagctgaggccgtgtggaaaattagtggagagctgacaagtgtctgggctcctggcccaggggtccgtggtccagcacgttgtgcgttcagtgggaagcaaagggcttgcccgggattacctgccccagccccgaggtgggttgtgctccctgcagctgccatcggcccgctttgcttcgtcctggcagatgcccagtgattgtccccgagcaagtgccagggttgggctgagctgctatgacagggaggcccagggagttctgctcagggagccaaagggaacagccagatcctgaatgttctatgttcacctgccccagccccacccaccctggcccactccacaggcccctgaccatggtcactcacggagagggatggaggagaaggtggttgaactgagtactgagaacccagaggacagagcccacagcttccaagcaggaaaagggacctctctgaaaaatctggataaccagaattatcacagcaccttctcattcccagcgcgtccttctgagctcagaccttgagcatttactgggtttctttttgaggaagagggaaagtgacaaaggacaaaacaatgcaaatcttcatgactgaagacgatcaaagactccctggagcgagaaaacagttactgccagaagcagaatggaagagccaaaaagtacacaaaatggacgccataaattctgaaataaaagtgtatgatgtgttctgagtcactgtagaagtcatgcatttattatcaagatagaaaagagcagagaatgacgtggacattggtcctcggagaggctgcgtaggtggtgcggtccccgggggattctggatgctggtcttttgaccgtggcggcagcctcgcgcctgcccggatggctccatccagacatttggcaaggctgtcatctgctcttgggtcctttttcaagctgatttcctgcctccccaagaggaggtttgagccccattctgccttggaaataaatcctgacagatgtgcacagcatatttgcagggaatttgcaggcctcgattattgggggaatcagagcccattccacaccgagccccatccacgtggctgagcaacacccctgtgtcccctgtatctgtctcactggctgtctttctcccagtttcttaaagaaccacaccattactgcgtttgccgttcgaagcgttgtcccaacaatgcagatggttctgacaagggctctatatgctggcagaagggagcttccaaccttttaacttgaggaaaatgaatctctgagaggcttgagagtgttgccaggtggagcttttcaggagacaggggtcttgagcccaggacacctaactatcgagttttcactaggagacttagtggtggctttcatgaggccagtcgttctcaaggaagggctgggggccatcagcaatgtctggagacatttttgattctcacagcttggtggggactgctattggtatctcatgggtggaggccagggatgccaccgaacatcctacaatgcacagggcagccccccacaaataagaattatccagccccaaaatgccaatagtgccgaggtcaggggaccctgtgctggccatcctatctctgattctgaaactatgcatgctttccacttttccccatttgtgagtcattgagtaaattaaagctcttctgagcagcagcagtgatcatggtcactgccctgcgttcaaataatgcgagctgaggacagtgatctgcaactcccagcatgtcatgtggtctcttagaaatccatgtgactgtttccaccatcttgggcatttgtggggacccccagactggagggagaaagccctacaaagtggatgggagtgtggggctgaacttttccctacccttaactttgtgtctctgggacctccagggacctggcccctcaccaatgcatatgaagagtatgcttggggaagagcttaggaatggggtgggcatgggagtgctgggtagcagcctttgagcaaatctgcatcttctcttatttctgacctttttccacgtgcccagtcctatttctgccagttgaaggcatactaatattctttatactatttaatcttttgcagaaaccttactattataacttgctactctccagataccaattcttcatgccgagagcatcggaaatgtttttgtgtcttactgatgttttcatgatcaacttgtaaatgtaagcagttgacttcataaaaggtattttaactattcttggagtcctttgctacccaagcacctggtttcaccatgcgatcactgacttctctacagtgaagactctttcttaataaaggatttcgctgtgctcttttgattaaaaatatctaaccttaaaagacgtaaaaatgtatctgtgaaatctcactttgttagcgttgctgctgttgtcattttctattatgataactgaaaagagaaaagaagaaaacatgaa

SEQ ID NO: 2397 - DNA, 562 bp, Homo sapiens
  ENST00000553764
agaagcccagagacagccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcaggtcaagtgagcctggggaataacaagtgaggatgccaaatcatgcatggaccagcctaactcctttccagtctgccgttgccacttggagttcttccagctgcccatgatggggggagctttcatggactcgcccaacgaggacttcagcaccgagtactccctgtttaactcctctgccaatgtccacgcggctgccaatggccagggccagccggaagatcctcctcggtcctccaacgacgccgtcttgctatggattgccatcatagctacgctggggaacatcgtggtggtgggcgtggtgtatgccttcaccttctgaggacggcacaccctgcaccaccatggggtgaggcttggcacgtagctctgacttgctgtcggcctttggctt

SEQ ID NO: 2398 - DNA, 774 bp, Homo sapiens
  ENST00000556728
agacagccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcagctgcccatgatggggggagctttcatggactcgcccaacgaggacttcagcaccgagtactccctgtttaactcctctgccaatgtccacgcggctgccaatggccagggccagccggaagatcctcctcggtcctccaacgacgccgtcttgctatggattgccatcatagctacgctggggaacatcgtggtggtgggcgtggtgtatgccttcaccttctgaggacggcacaccctgcaccaccatgggaaaccttactattataacttgctactctccagataccaattcttcatgccgagagcatcggaaatgtttttgtgtcttactgatgttttcatgatcaacttgtaaatgtaagcagttgacttcataaaaggtattttaactattcttggagtcctttgctacccaagcacctggtttcaccatgcgatcactgacttctctacagtgaagactctttcttaataaaggatttcgctgtgctcttttgattaaaaatatctaaccttaaaagacgtaaaaatgtatctgtgaaatctcactttgttagcgttgctgctgttgtcattttctattatgataactgaaaagagaaaagaagaaaacatg

SEQ ID NO: 2399 - DNA, 536 bp, Homo sapiens
  ENST00000553782
gcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcagaacaaagacaaatcccggatttctccatcagtctgtgaccctagagaagacccagagctggctccagggaagggctgcgtttggcctgggagactgcccatgatggggggagctttcatggactcgcccaacgaggacttcagcaccgagtactccctgtttaactcctctgccaatgtccacgcggctgccaatggccagggccagccggaagatcctcctcggtcctccaacgacgccgtcttgctatggattgccatcatagctacgctggggaacatcgtggtggtgggcgtggtgtatgccttcaccttctgaggacggcacaccctgcaccaccatggggtgaggcttggcacgtagctctgacttgctgtcggcctttggcttct

SEQ ID NO: 2400 - DNA, 7583 bp, Homo sapiens; identical to SEQ ID NO: 2396
  ENST00000555004

SEQ ID NO: 2401 - DNA, 562 bp, Homo sapiens; identical to SEQ ID NO: 2397
  ENST00000553764

SEQ ID NO: 2402 - DNA, 774 bp, Homo sapiens; identical to SEQ ID NO: 2398
  ENST00000556728

SEQ ID NO: 2403 - DNA, 536 bp, Homo sapiens; identical to SEQ ID NO: 2399
  ENST00000553782

SEQ ID NO: 2404 - DNA, 233 bp, Homo sapiens
  ENST00000556788
tgagtccaacagactcaatcatacatgtcatacatgtttatgattaagagatattctttttgtgtgctagttgattttgccgagaaaaaatgaagaagaattcaagaatgagatgagggtgtcttcttcctgtagaagtccaaatgaaacaccttatttccaatcacagccacaacctgggggagaagaatcaaatcctccacagggattgtgatttctgcagatatgaataa

SEQ ID NO: 2405 - DNA, 6495 bp, Homo sapiens
  ENST00000267485
ctccccctagcgtcccagacagcggagggagtcgccgccgctaccgccgccgccgccgcagggcccgccgctgggatgccgagcgcccgcgccgccgctgcctctgtcctccgcgcgctgctcagctgaaggcgcacaggattcaattactggacttgtcaactctgccagtgtacgtgccatttctcttccactatgagaggaccgattgtattgcacatttgtctggctttctgtagccttctgcttttcagcgttgccacacaatgtctggccttccccaaaatagaaaggaggagggagatagcacatgttcatgcggaaaaagggcagtccgataagatgaacaccgatgacctagaaaatagctctgttacctcaaagcagactccccaactggtggtctctgaagatccaatgatgatgtcagcagtaccatcggcaacatcattaaataaagcattctcgattaacaaagaaacccagcctggacaagctgggctcatgcaaacagaacgccctggtgtttccacacctactgagtcaggtgtcccctcagctgaagaagtatttggttccagccagccagagagaatatctcctgaaagtggacttgccaaggccatgttaaccattgctatcactgcgactccttctctgactgttgatgaaaaggaggaactccttacaagcactaactttcagcccattgtagaagagatcacagaaaccacaaaaggttttctgaagtatatggataatcaatcatttgcaactgaaagtcaggaaggagttggtttgggacattcaccttcatcctatgtgaatactaaggaaatgctaaccaccaatccaaagactgagaaatttgaagcagacacagaccacaggacaacttcttttcctggtgctgagtccacagcaggcagtgagcctggaagcctcacccctgataaggagaagccttcgcagatgacagctgataacacccaggctgctgccaccaagcaaccactcgaaacttccgagtacaccctgagtgttgagccagaaactgatagtctgctgggagccccagaagtcacagtgagtgtcagcacagctgttccagctgcctctgccttaagtgatgagtgggatgacaccaaattagagagtgtaagccggataaggacccccaagcttggagacaatgaagagactcaggtgagaacggagatgtctcagacagcacaagtaagccatgagggtatggaaggaggccagccttggacagaggctgcacaggtggctctggggctgcctgaaggggaaacacacacgggcacagccctgctaatagcgcatgggaatgagagatcacctgctttcactgatcaaagttcctttacccccacaagtctgatggaagacatgaaagtttccattgtgaacttgctccaaagtacgggagacttcacggaatccaccaaggaaaacgatgccctgtttttcttagaaaccactgtttctgtctctgtatatgagtctgaggcagaccaactgttgggaaatacaatgaaagacatcatcactcaagagatgacaacagctgttcaagagccagatgccactttatccatggtgacacaagagcaggttgctaccctcgagcttatcagagacagtggcaagactgaggaagaaaaggaggacccctctcctgtgtctgacgttcctggtgttactcagctgtcaagaagatgggagcctctggccactacaatttcaactacagtcgtccctttgtcttttgaagttactcccactgtggaagaacaaatggacacagtcacagggccaaatgaggagttcacaccagttctgggatctccagtgacacctcctggaataatggtgggggaacccagcatttcccctgcacttcctgctttggaggcatcctctgagagaagaactgttgttccatctattactcgtgttaatacagctgcctcatatggcctggaccaacttgaatctgaagagggacaagaagatgaggatgaagaggatgaagaagatgaagatgaagaagaggaagatgaggaagaagatgaggaagataaagatgcagactcgctggatgagggcttggatggtgacactgagctgccaggttttaccctccctggtatcacatcccaggaaccaggcttagaggagggaaacatggacctgttggagggagctacctaccaggtgccagatgccctcgagtgggaacagcagaatcaaggcctggtgagaagctggatggaaaaattaaaagacaaggctggttacatgtctgggatgctggtgcctgtaggggttgggatagctggagccttgttcatcttgggagccctctacagcattaaggttatgaatcgccgaaggagaaatggcttcaaaaggcataaaagaaagcagagagaattcaacagcatgcaagatcgagtaatgctcttagccgacagctctgaagatgaattttgaattggactgggttttaattgggatattcaacgatgctactattctaatttttattttggagcagaaaaaaaaaaagaacaacctgccacattgctgctatcaggccgttagtcctagtgtctgctgggtgctgggtagtagatttttcttgtactgagcagaaatggcatgttgtatactaaacgtatcatgcagtatttggttttattctgtagtgaattttccacaaccgtgggctacaactcataaatatgcaacatatatgtttttcagtaggagttgctacattaggcagagtaaatattttgtagttttccacagtgtcttttccttggtttgaattacctgcattgagaataatgattgttgccaccaaggcatgcttgactctgagatataaatcttaacaaagaataacttctcaagatatactctacctacttgaaaccacagggttgtgggccatggtacatactgcatttgcatcaaactagcagtaactcagaatgaaatcattttcattaagaagctctctcagcatattaggattatatgtagatttgtatgtattttgcattatgtacttcagtctcctagttttattattctcaccttccgttttattcttggcgaggaaaaaaatgcactagaaataatacattaaactgactcttagtcttaatgtacgtttgctgtcttaaatagtgtgattgagtccaacagactcaatcatacatgtcatacatgtttatgattaagagatattctttttgtgtgctagttgattttgccgagaaaaaatgaagaagaattcaagaatgagatgagggtaggtaagctctcagagcatttctgtctgccatttggttctatgcttatgtggctgctaatgtgactaattcagagtgttgtatttccacatctgtggactccaccatggaaaaggtgggctaccattggtccttatatggctttattagaaaaatagacattctatcgtttgtctgcccagtggccagagtcctggtgaacaacagagctcatgggaaaccagcctctctcagggcaccccgctatgaggatattgaaatatgttcaatcatttctcatctcccttggaatgtaattccctgccctatacaaaataggatattccaatgcgctatttgaatctagggattgaggatttgtagttgagttttggggtaaaggcttggctcattgccatggaagaataaaagttatttattaatagtgctgtcactgtggagtacttgttggtgtttattagaagttgtctactatgttcaagaaaagttgcacagttattcctcagagctactatgtgaggtaggacatatgtttttattctcccatttgactgaagatggaactgaagcagagaagtgaaatgattttccaaagttgtacccagagagaatcagcgtgagaacccacttggacccagccatgcacccttatcttcagttcagtaaccttttcatagactttggtggaagcagtgacatttcagggtccttctttaaaacaaaggttctaagggaatagcagggaatagctgcctggtcaaggaacgtttgatgtgaatttccatctttgttaaatgaatgatgcctttctaatttctctcttactcacacacaagttctttccttccccatctcagttatcagttatttcctttacagtcatacatttgagtatcacctctatggaactaataaaccttcctagaatccgtttttgaataatgtctggctcacaagaacattttcatcaaataattttaactctttttgccaagagatgtaagcaaatatgtgaaactgatcaagagaagtgaaaagctctgtacagtcaaatagaagttagcaactggcaaattagctcaaggtcagattttaaaaatagaattcagaatcatgacactcagaagtgatttgtaatttcacgagtagagacatcctgatattgcataagggatgttttccttttctaagagcagccctttgctgtaagtgtttctaaggttgggagtaagtgagcatggtgtggcattactgtctttgtattcttgacaaactatttgttgagaatacgtcgtaggccacttaactgagtagcacatgggtgatactagtggccattattgccttgggctactcaatctatagtcttaactaaaccatggctaataggttgaatcttcaaactgtagtgtaataaattcccaaataacagacccatattttcatttctcagaggtccgtgaggatgacatgtatgtgaattttggcttaacacagtatctctgtggtcctttttgggacacatgatttcttaaaggaaaagattatacttagagtacatttctgtacaaacccatttaaacatctggattgagtggaaggtcggtggatggtacaaatgacatgtttattttggccattttccttgctgctggtggctgtggaataatgattttcagtggttggcttagattattaagaggatcagaaaaggttgtcatattttaaacaaaacctgggattagagatgctgctacgagatggaagtgctggccagtggttatatagtggtccagttgagaagtagtaaatcaggcacttgtaggtttacccaaaataagtgacaagtatgcttatatttgcacaattaaaatagaaagtcaactttttattcaaacaactaggcttaaaacatttaacagtgaaacaaataaagctgtctggaaaggagggctgattcctgcagcttcagttgtgaacaccatccccactggactgagtttacccagccagaactgccagcatcccaccgcaggggcaggaactaggtcttcttctcggagggagaggcagtgtttccagaatttgcaggctcataaaaatcacctgggacacttgtgaaacatacagatctcaaggccttgccccagacctgatgagttagaatctccagggaaggagcttggggtattcatgccccagcaagcttgggaacacagctaggagggatctatctagagaaccacttccttatgatagagacaaggtcatttaaagtcacaatgagataccacctcacacctattgggatggctattattcaataaaacaaaatataacaattgtttctgaggatgtggagaaattggaatccttgtatactgtgggtgggaatgtaaaatggatagccactgtggaaaacagtatgaagattcctcaaaaaattaagatagaactactatataatccaactatcccacttctgggcatatatccaaaagaatagaaatcaggatcttgaagaagtatctgtacgcctgtgttcattgcttatgcttataagcatattattcacaataagcttataagtattattcacaatagccaagatatggaaattgcattgatagatatgcaaatatctatcaatagatgaatggataaagaaaatgtggtatatacatacagtagaatattattcagccataggaaataaggaaattctgtcattgtgacaatatggatatacatggagaacattatgctaagtgaaataaactagtgacagaaggacaaatgcatgattgcacttctttgaggtatccaaaataatcaaactcataagggcagaggcaaaatggtgcttgccacgggctgggcaaagttaaaggtggggagatgttgattaattatgtttcagttatgcaagatgaataagttctagagctctgctgtataacatagtgcctatagttaacaatatcgtactgtgcagttaaaaatttgttaagagggccgggtgtggtggctcacgcctgtaatcccagcactttgggaggccaaggtgggcagatcatgaggtcaggagatagaaaccatcctggctaacatggtgaaaccccatctctactaaaaatacaaaaaa

SEQ ID NO: 2406 - DNA, 1748 bp, Homo sapiens
  ENST00000557175
gttcatgcggaaaaagggcagtccgataagatgaacaccgatgacctagaaaatagctctgttacctcaaagcagactccccaactggtggtctctgaagatccaatgatgatgtcagcagtaccatcggcaacatcattaaataaagcattctcgattaacaaagaaacccagcctggacaagctgggctcatgcaaacagaacgccctggtgtttccacacctactgagtcaggtgtcccctcagctgaagaagtatttggttccagccagccagagagaatatctcctgaaagtggacttgccaaggccatgttaaccattgctatcactgcgactccttctctgactgttgatgaaaaggaggaactccttacaagcactaactttcagcccattgtagaagagatcacagaaaccacaaaaggttttctgaagtatatggataatcaatcatttgcaactgaaagtcaggaaggagttggtttgggacattcaccttcatcctatgtgaatactaaggaaatgctaaccaccaatccaaagactgagaaatttgaagcagacacagaccacaggacaacttcttttcctggtgctgagtccacagcaggcagtgagcctggaagcctcacccctgataaggagaagccttcgcagatgacagctgataacacccaggctgctgccaccaagcaaccactcgaaacttccgagtacaccctgagtgttgagccagaaactgatagtctgctgggagccccagaagtcacagtgagtgtcagcacagctgttccagctgcctctgccttaagtgatgagtgggatgacaccaaattagagagtgtaagccggataaggacccccaagcttggagacaatgaagagactcagacatcatcactcaagagatgacaacagctgttcaagagccagatgccactttatccatggtgacacaagagcaggttgctaccctcgagcttatcagagacagtggcaagactgaggaagaaaaggaggacccctctcctgtgtctgacgttcctggtgttactcagctgtcaagaagatgggagcctctggccactacaatttcaactacagtcgtccctttgtcttttgaagttactcccactgtggaagaacaaatggacacagtcacagggccaaatgaggagttcacaccagttctgggatctccagtgacacctcctggaataatggtgggggaacccagcatttcccctgcacttcctgctttggaggcatcctctgagagaagaactgttgttccatctattactcgtgttaatacagctgcctcatatggcctggaccaacttgaatctgaagagacggggtttcaccatgttgcccaggctcgtctcaaactcctgggcttaagaagtctgcctgcctcggcctcccaaagtgttggaattacaagtgtgaactcctgcacccagccaagaaaatatttaaacagctgcctgaaatggaaattgaatccaaaacattttgccactggtgtttgaagtggactatcttgtctcaagcctttttattttctcatgaatgtaccttctaaatattgttaaggctacaatggaggaaattttaaattattatatttactattttacagtgagtggaaaatttgaaatttagtaaaaagttttcaagaaatttttatagattaataatggagtttaaaaagtcatggcgatgaggcatttaacaaggag

SEQ ID NO: 2407 - DNA, 2380 bp, Homo sapiens
  ENST00000334342
gtcgccgccgctaccgccgccgccgccgcagggcccgccgctgggatgccgagcgcccgcgccgccgctgcctctgtcctccgcgcgctgctcagctgaaggcgcacaggattcaattactggacttgtcaactctgccagtgtacgtgccatttctcttccactatgagaggaccgattgtattgcacatttgtctggctttctgtagccttctgcttttcagcgttgccacacaatgtctggccttccccaaaatagaaaggaggagggagatagcacatgttcatgcggaaaaagggcagtccgataagatgaacaccgatgacctagaaaatagctctgttacctcaaagcagactccccaactggtggtctctgaagatccaatgatgatgtcagcagtaccatcggcaacatcattaaataaagcattctcgattaacaaagaaacccagcctggacaagctgggctcatgcaaacagaacgccctggtgtttccacacctactgagtcaggtgtcccctcagctgaagaagtatttggttccagccagccagagagaatatctcctgaaagtggacttgccaaggccatgttaaccattgctatcactgcgactccttctctgactgttgatgaaaaggaggaactccttacaagcactaactttcagcccattgtagaagagatcacagaaaccacaaaaggttttctgaagtatatggataatcaatcatttgcaactgaaagtcaggaaggagttggtttgggacattcaccttcatcctatgtgaatactaaggaaatgctaaccaccaatccaaagactgagaaatttgaagcagacacagaccacaggacaacttcttttcctggtgctgagtccacagcaggcagtgagcctggaagcctcacccctgataaggagaagccttcgcagatgacagctgataacacccaggctgctgccaccaagcaaccactcgaaacttccgagtacaccctgagtgttgagccagaaactgatagtctgctgggagccccagaagtcacagtgagtgtcagcacagctgttccagctgcctctgccttaagtgatgagtgggatgacaccaaattagagagtgtaagccggataaggacccccaagcttggagacaatgaagagactcaggtgagaacggagatgtctcagacagcacaagtaagccatgagggtatggaaggaggccagccttggacagaggctgcacaggtggctctggggctgcctgaaggggaaacacacacgggcacagccctgctaatagcgcatgggaatgagagatcacctgctttcactgatcaaagttcctttacccccacaagtctgatggaagacatgaaagtttccattgtgaacttgctccaaagtacgggagacttcacggaatccaccaaggaaaacgatgccctgtttttcttagaaaccactgtttctgtctctgtatatgagtctgaggcagaccaactgttgggaaatacaatgaaagacatcatcactcaagagatgacaacagctgttcaagagccagatgccactttatccatggtgacacaagagcaggttgctaccctcgagcttatcagagacagtggcaagactgaggaagaaaaggaggacccctctcctgtgtctgacgttcctggtgttactcagctgtcaagaagatgggagcctctggccactacaatttcaactacagtcgtccctttgtcttttgaagttactcccactgtggaagaacaaatggacacagtcacagggccaaatgaggagttcacaccagttctgggatctccagtgacacctcctggaataatggtgggggaacccagcatttcccctgcacttcctgctttggaggcatcctctgagagaagaactgttgttccatctattactcgtgttaatacagctgcctcatatggcctggaccaacttgaatctgaagagacggggtttcaccatgttgcccaggctcgtctcaaactcctgggcttaagaagtctgcctgcctcggcctcccaaagtgttggaattacaagtgtgaactcctgcacccagccaagaaaatatttaaacagctgcctgaaatggaaattgaatccaaaacattttgccactggtgtttgaagtggactatcttgtctcaagcctttttattttctcatgaatgtaccttctaaatattgttaaggctacaatggaggaaattttaaattattatatttactattttacagtgagtggaaaatttgaaatttagtaaaaagttttcaagaaatttttatagattaataatggagtttaaaaagtcatggcgatgaggcattta

SEQ ID NO: 2408 - DNA, 557 bp, Homo sapiens
  ENST00000555101
cagtcgtccctttgtcttttgaagttactcccactgtggaagaacaaatggacacagtcacagggccaaatgaggagttcacaccagttctgggatctccagtgacacctcctggaataatggtgggggaacccagcatttcccctgcacttcctgctttggaggcatcctctgagagaagaactgttgttccatctattactcgtgttaatacagctgcctcatatggcctggaccaacttgaatctgaaggtattcatgctttgaaggggatcttttcaaggactggttgagtgagtcactgagcaaatgtttttgaaaaagaattaagtaggagtatattcaatctgcagtatagatcagaggacagtaaactacagctgggccaaatctggcctgccacttgtttttgaatggtttgtaagctaagaatggtttttacattttgaaatgattgaaaaaaaaagtcaaaagaagaataatattttgtgacatagaaaagttataaaaattcaaattccagtgttcataaataaagctatattggaacacagcca

SEQ ID NO: 2409 - DNA, 572 bp, Homo sapiens
  ENST00000554218
aaaccagcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggattcaattactggacttgtcaactctgccagtgtacgtgccatttctcttccactatgagaggaccgattgtattgcacatttgtctggctttctgtagccttctgcttttcagcgttgccacacaatgtctggccttccccaaaatagaaaggaggagggagatagcacatgttcatgcggaaaaagggcagtccgataagatgaacaccgatgacctagaaaatagctctgttacctcaaagcagactccccaactggtggtctctgaagatccaatgatgatgtcagcagtaccatcggcaacatcatta

SEQ ID NO: 2410 - DNA, 830 bp, Homo sapiens
  ENST00000370375
gccccaggcaccctgggcgctctgccctaccggcggcgcctctcactgctcacggaacgttctggaagtttgggaaaccctgagcggtctctgaggacctggtgagcagattgttgcaccattagaagctaggttgatccacagacagatggctgaaagtggaaaagaaaaaataaaatggacaaccaccattattattagctcatctcttaagagttatgaagttgcaactgccctagaaaatcgaagccacaaagttcgatattcagattcagtggaaaatggatcaattatattttctctttctggagttgcatttttattaatggatactaaggaatgtcttctgtcaactgaagaaatatttctagccaaaattgagaaatttattaacattcaccaaaatagttttttggttttgtctgctgccctccatgggcctgaagaatggaaactgatgttcaggattcagcagagattcctgggttgtaacttacgaatacttccagtacacaacacagtaaatgctattaatcttatgtgcactatagcaaagactacctccaaaccatacatagatagcatttgctacagaatgataacagctaaagcttacatcattgagcaaagtcctgtttggaaaacacttcagaagataaaactgaatagtgattcagttaacccaaattagagtaccaacttaatgtttttctcgaagaatgtgaaaataattagacctgttaaattataatattcaaatatctatttaaagacatttatattaatttgaaataataacatatacaattaaaagtgattttattttagga

SEQ ID NO: 2411 - DNA, 871 bp, Homo sapiens
  ENST00000370373
gaggacctggtgagcagattgttgcaccattagaagctaggttgatccacagacagatggctgaaagtggaaaagaaaaaataaaatggacaaccaccattattattagctcatctcttaagtagaaagaaggtctcgctacattgcccaggctgttctcaaactcctgggctgaagtgattctctcacctcagcctcccaaagtgctaggattacaggtgtgagccattgtgcctggccaagtttaaattttaacctatcaggaaaaactattaaccacctagattttagtattgtgggtaatatgatttaattgcctgggtggaataggaaatcaggtgatatttgaaatgagttatgaagttgcaactgccctagaaaatcgaagccacaaagttcgatattcagattcagtggaaaatggatcaattatattttctctttctggagttgcatttttattaatggatactaaggaatgtcttctgtcaactgaagaaatatttctagccaaaattgagaaatttattaacattcaccaaaatagttttttggttttgtctgctgccctccatgggcctgaagaatggaaactgatgttcaggattcagcagagattcctgggttgtaacttacgaatacttccagtacacaacacagtaaatgctattaatcttatgtgcactatagcaaagactacctccaaaccatacatagatagcatttgctacagaatgataacagctaaagcttacatcattgagcaaagtcctgtttggaaaacacttcagaagataaaactgaatagtgattcagttaacccaaattagagtaccaacttaatgtttttctcgaagaatgtgaaaataat

SEQ ID NO: 2412 - DNA, 10265 bp, Homo sapiens
  ENST00000235307
cccactcccggggggacgttccgtgccgcggccgccgcggccgctgcttctttcacactttagttgggagctgcgcgccgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaaagacgaggaggacaggggcggggggcgggaggcttgccaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactgctaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatggggtggttgagtgggtccgcacgaaatgcttgattatgtcagcaacacccaacactgtctgttttccatttgttggttttaatcataaaattgtcaagtgattcgtgtttgtactttatttttttgtgccttctgaaaggatctaaaacaaaaatattttgcctttttttccccacgtgtatctgaacattaagcagattggctcagacacaatgaaaaggataatccaatgtacgtgctggtgcactctgctagttgttatctctgtagggctcaggaagctggaaggaggaagggagggtaagtggcctggtgagtggaggtagaaaaatgatgagaaatgaactgagagcattaagcagagagggttgataggctggccgtgtccggggtgaaattggaaatccagctgcctagtggccagtgggtggggcaagactgtcaacgagatttacagctggcttacacatgccttatgtcctctgagttgtagagttgtaaaagttcagcagtgtgtgcacagctttcttttggttggcagagattcaggatcatggagtactgctctcataattgaagacgtgtttgttattggcagagaaccttaaaaaaggcctttacctcagcgatgcttcctagccccaggcttgcagagaacacagagtggtgttgtggtctatttagggacaaagaaggtataaagtccagagatgagaaaactgggtcagccctcagaaactgcagcagccacgcacacagaagcctgctggaagacaggtctctctccgtccacagtgcccatcatctgagcctgggctgggatgactcaacttagcaaagacggacccaggaggagtgctggttcttcagtctttgtactggccccatcctctcctcactgtaatgtgaggaagcacctctgtgtcagggctcacctgggcatccaaagcggccacgcccacaatccgacagcccccaggagcaggtccagggatgatgcagcccccttcttggtcccatgtgatgtcatcctgctttgttatcttcttataactttatcctgctataactttatcctcttcccagcctcatccctgtttttctgttagggcaagactcttccataagcctgctaaaaaacagagatgatacctcttacaaactttacctcatagcctgtgaagcaggttggcatgtggattacaagtcctgctttgacactgggcaagaatttaagattgttctatctctactagtcatagaaaagaaacattgttaaacatgttgagttttaaaggaagaaatattttcaaattcttaatccaagaaaatactgagttggaatcttagacttcgggactctgacacgttctttatgaaaggcaaaataattggtatctaaagttctctccttcctgcctcccctaaagaaaaaggatattagattgcacactataattttacataagatctgccttccacacttccctgctggaaggcattctcagagctttatgtcttcgtacctctcagagattggactttttcttgtttaaaaccccaaccaaaaaaaataataaggcatgattggtggggagggaatgtgtatttaggggcataataaaaaggtggctcgaagcaggaactttggcctcatggtgtcatgggtggatgcctggactccagtgtgcctgtgaggggctgggttaggcagtcggctgtcacactcacatgtgcctgcaataaaccttttggaatttcatgaacgaggtctatgaattgccttttgccaatgaatggatgtatttttccaaggggggaatagtatccttgactttggcagtcacctttttgtatgtctctagaaaggggtcaaaaaactatggtaaagatgaggcttatgagtgaatacctctgggacaaaccttaggactcacaagctatgccatgtttttcaggagactcttgtaccttatctggaatctaatcttgggagaagaggaaaaaggagctaatatttgtcatttatactcactctgtgccagatactgtgctaggcattttataattgttttgtgtcatcctcatgataatcctgtgaagtagatctattacccccgtgttctaaataatagatcttaagtgtggaatgcatctatccaacataaatgcccatgttgaaagaaggaaagatgtcattcaagtatttttcaaattctttttattatgactatgcccttcgcaacactgtgaaaacaacccctgggggcatctgccttccagaatctctctctggcttctcaccagcttggtttcctcatggggagtgttttatttggcctcccctatctgagctgcacacacaccaggggaggccactggctaacagtaggacttcagtgccctgaggaaaaggctttgggaatttaggcacacgtttctctccttggaatccttctagcatctggaaaaggaacctggtatttctgcagttagataccagatgcaaccagaacaggctttcgagtgctgtgatttctttcctgggttcccaagtcttgttgtttcatcacaaactgtatctttttaaggttaaaagtcttgaccttcatgggggtctgggacaatccgatctccaagcatggaggaaaggcaatgcctggaccactgacttgcattgaaatcctttcttgtgggctagggtttgatgtctctttttcatctttggactggggatctgcatcttccaggtccatttaagcactgaaactagatgcaaatctctttcgagaccttacatgttttagatagtcatgtaatgacttggatagacatttaaataacttgttccaaggtcggaagagcccaagaactcctcagagttcctcttcttgcttcttgaatcacatcctctaaagatgactcatgtctccatagcaactgttaaaggtgctgcctagacgggacccgctcccacctttacttactttgctcgaaggaaccaaaacaatgtccttgtgtaaaggggctgtcatatccagttttcctttgaaatctggcccccaagatcctgcttctttctaacctggcagctgtcatgtcccttcaagatgatgtgggaaatggcccttacaacttgggaaccacagaaattgctgtatttcgggaagattcacctctaaactgaaggcttcattctgatagtgtctgccctctctaccctgatttcgcccttctttgcttccatttttagcccaaggctttgaatttgattgagtaagacttagaggcagtataaagaacaccataaacttaggcagaggtcccttagggtctctagagttgaaaataattctacagccttagggggacctcttggcattgactctaaagggagagaatagcccctgtgtcctggcatttcagtctagaccttcaaggactgttctctcttgacaggcaagcaagcaaagaaagttttgcaatagatttcaagccagtttttccattcaaaccaagatgcaaattcataaaattactcttttcctggaatagatccaggcagctgccttattagaactttagattcggatctattttcttaacacacatacacatacacgcgcatacatacatatacagagagatacgtggagaaaggaaatttactctatcattgcaatacttcaagaaagagctgtattttgcctttctgtaatctccaagatagtgtctaggaaagtaatagtataactatagggataccgaaacaggaaaaaccagccatcactcttgagaaagtttgagttcgactcacatgggagaatcgaggtctgctactcgtcttgctttgtgccccatctgtgcctggatgccctactacatctgcttgactcgtctgggctgctagccggggtgttgtggctgacatcctttcctggccttacacacataatagacacatccctaacggcgtgtgcctggtccagccacatacagccaccacatgtgtcacacactgtccccctcatccatgtggacttgactggcatttcagcagctccactgggatgctctaaccccagtgtgtggagttggggtcccttcatctaggttgacccaggtatagcatttttagcattgcctttccagtcttgatgattcattcattgaactcatttatttctggagcccctggtacactccaggcactgcgctaattgccagcaaagcacaactgaactaaatccaccttcaaggaacctagccataacgagggaggcagcatggaagtaccctacaggggaaagtcctgagtgctgtgggagcatctcaccgtggcagccagcccagttttggcaatcaggggcttcctgaaagaggtgacatcaaagcccggatgtgtcagaggactgagggagagtgttactaaaggactttcaggctgagaggatagcacaggactcagcccaaaggagggccagtgtggactgtccagggccagcctgcagtacagaggctggagcttggacttgtagagggagagagaagagcaagggacgtggacggggcagtgagccaggctagccacagagggttcccggggctttgctggggattcagggagcataaataagagctttaggtggtgctgtgtcctctgcagcccactgctgaggtcctccagacaggtaaggtgtggtcacaatcagggccggggtttccctgctcactgcggcagtgcaggggtgcttgctgagatgattcatcccagggtgtcctctgtcccttacccagccccaactcctcttcctctgccaaaagctatttgaattcaaggactttaacctgggccggatctggtttggagacaaaggggacagctctgggtcagcatgaccttctttagagccactaaggcgaaaaataccgtttgggaccaggctggcctagacccagggatgagaatgcaccctaaaataaatatacgggaagcagcagagggcttccctgtctagtgtgtgatcctaactaaaggcagctctcttggacagccttcccctggattaggtcacatacacctggtggccaagcctctgctgggtcccaaatacacacccgagtcctgccaaagaaaggagatttttaaaaagcacagacaaattgtatgcaagtggaaaatacccataggcctagacagctgtggagggaagacctcgtgggtacctggaggctgccagagctgggagctctgcaggtatgagtcagggaaggctcagagacaagcagaatctctctatggagacaacttgcagtgccttttaggttttccaaataacctcggagttcagagcattgggtttttttctcccctccccacccccagaaaaataattagaaaaatgtttaggagaaaggaaaagaattagatgcatcagaataccagctataagccaacactgtttccagaaactcaagaaaaagctcaaacagaagacagttcccctgagaggctggaggcgttggtgctgaaggcaattttcctagctaaggggcactgggccttgctgcaccttggggctgaccttttttgcaaaacacccacccctgccctcctggcatactcaacagcaacgccagctttctggacccttggaaagatgttagctcaaacacccactttttccagatcttcctcttgctcttcactgaggaatttgtaattctgaggctagcgatgcccactcggatattccgcaggcccaggtgtttagattagaatttgtccagcggtaatcctgatgctggaaaccaacaaacatttggcctcatattcacccatttaaaaactagagcccctggcaggtccccttagggccatgtgttcatggaatataagccaagtttgccttaggcttgttcatggaatataagccaagtttacctctccccattttctgccctggcccacttcccactcacctccacctcattgccaggaagggatcaaaatgcctccatgccagttgttaatggctacatatttgcccttcccaagggtatttgcattttatttaggaacatggccttatattcaaggaaaatctagcatcaagattacgaggcatcacctctcaatcaggtctgggaggtatcttggggcattgctcttctgaacacctgcagaggcttcctcaggtgagtgtgggagcccggaagggtggcctccctaaccactctgcctgcacatgaattctccaaagcagtgggcccccatctgtttcaattacacatgcctgtcagcaaaaacttcgtgagatgcactctctctgtgtgtttattaatttatttaaagcatatatccctttacttttgtactactatattaggcacattataaaaagtatacagcatagaaactttaaatgaataagacacaaaatattataaacagaggttctggcattttctctctgaactcctgagggggaccttgggcacctcctggtatgtgcacaccccactttgaacacccttgctttagtgcaaatcagcacgcctaaatagcatcccaaaccactgtgcgacatttggcctgcagaataagaaagtcctaaggcagaatccccaggaacttcaaatctgggagatgaggaaagaaaactcactcacaaacaacataaatgtaaataattcaaaaccctaaaggagagctgtccctagacagtagtggctacaggtgctaagcaaaagtcaggtacactggacagagccatgcgattgattgttcatcttccctctctgggtctccagaaaaggacactggcaatatccccagctctctcctgattggaattctttgaaccctcgaagtgctccagcagtactaccccccacgtagcagtgggcccatgtcgcttgaatattatttttgatttgaccaccaagatgtaatgatgattctattccattttgaaaagggtctgagaaagtgtacaggtctaattatatatacatatttatacatgtgtatttttgtttattgttacattttgacattggactttctattaaataatttttaagagttg

SEQ ID NO: 2413 - DNA, 426 bp, Homo sapiens
  ENST00000489143
agaaataaacccttgttgttttaagccattctgttttggggatgtttgttactacaacataaccaaactaaaatacctcacctatggataatgagtggtaacatgtcaggttgtagatgaagtacctggcaagcatgtcagaattctgagctgccactggatgagaaacttccatgtcagagaatcctttctccttcctacatggagaggtgccctagggtgaaatgcttcagtggaaattctccttcgattatgaagttgcaaagtctgtccttcggtctgccaacttttccttcttactatctgtcaaatcctgatttattcagaaaaaagtgccagctcaaatgtaagacttaaaactaataaagaggttccgggattagttcatcaacccagagcaaagtacatcacaattggaaagttaaa

SEQ ID NO: 2414 - DNA, 644 bp, Homo sapiens
  ENST00000367514
actggcaaccaccattctactttctgtctccatgaatttgactactccaggctgctgtgcattttagagaagttcttatgtgatactgaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctc

SEQ ID NO: 2415 - DNA, 399 bp, Homo sapiens
  ENST00000477517
gccagctcaaatgtaagacttaaaactaataaagaggttccgggattagttcatcaacccagagcaaacatgcacatctctgaaagccaacaagaattcttcagaatgctggatgaaaaaattgaaaagtatttatttatgaatttctaagctatgatgtatatcactcaacagaagataatgaagaaggtcttaaattcattagtattatttagcagcagatcccactttgacatggaccctctgagagaataattgtatcatcttctaagccaccattaaaagaccagcaaaggtcaccaatgcgaaaaatagagatggataatgaattaaaatgagagttaaatctataatgttccctggatgtaaataaataaatacttgttaaagtataataat

SEQ ID NO: 2416 - DNA, 3138 bp, Homo sapiens
  ENST00000608007
taagaattttcagttctattctttagatactgctacatctactatttttactggaaaccaaattgtaagctggtttctttattcatttctctcctcagcccctcattttaataccctcctattgaattctaggtccagaaagccaaaggcaattttctctcaaatatttgacccaagtgttgcattatcagccacaccctcactcttggacaaattctcctcccacccaattccaggcatggaaagggttttgttgataagttcttacagtcacaggaatcatcctagtcagcaagccgtgggagagacagaaatagaaacagcaaatttgaccaaaccaaggtccatgtttgggtgttttcatttatcaagcacacaaatctctgagcctcaattcagatatttgtataatcaggataagaaacccttaggattattgtgtgcagaaaatgaagaattctatataaaagatcgtatactatgttatgacactcatggttaaacggtaattcttagattgcagaaaggttaaaggctacagtttggaaagactgatagcatatgatttgtttcagaatgtaaaaagggcagctctctggcatgttcctgactgaggatctcataacatttaacttgaggaacttcctccttttccagctttgggagtcaaggtgagactcctggggacctaggtaggaagtatctgaagacttgggagaggaggcacagtccttgggaagcctgataaagggaagaggttggagtccgcgtggcagaatggccgttgttttctttctccttaatggatattaagacttattggtaacagcacttaggatgggtaaactgacttacatagataaatacagaatgtgtaaatgataatttcaagtttatgccattaagctcctggattctaagtaactaaaaacacagtttattaaattaaaggacaagttaggtagtggctataattaacaaatcctatagagacctgcctatcagcatgtagacttgtcttcataattgagtgactttaagaagggatgtcttctctcccttcgcctcacaaaccaacatccccccagtccccagtgcgattcctaaggttggtaacccaccagagtcacacaggcccctatgtctgaaagtctttcttgaagtctgcatgttcaaggtttgaaagttggaatctggttatttattttttcaccttccttcactccaatgttctgggtatggattgaccttcccacctcccttcctttgctattgggacctcagaggtcttgaggggtgagtatgtctcatccagagacagggtgtgctgacttccctaggagatcatgagtttaggttaatgctttaaaatcactggagaagcagacaaaactataaaaacattcttggggctttgaggagaatgaggagcagagttatggaaggaagggtgggtgggtgcatatttagataggagagagaaggggaaagggggaaccccctccttgccacccaggctctcccagggccaaagtgacaccccctcctcctcctgccctaatccccccattaaggcagctctgagtttgttatgacaggggctgaaggctgctgaattgctgtttgctgtgtctgctaattggactgaagggttggagtctggacactgaaagggaccattgttgctgtttaccttctacagccgcctccctggggaccctctgggtaaaggggagcagcagcacccccttagggtcattgcacccatttcctgcacaagggactgcggtggggagacagtttgtctcattgccttggggtggtttgagcttctacagcacagaggagacaagccaacacctgagccagtctcttctccaggccaggcctaggggccatccaggagctcccaggaaagaggatttacatgcttgtctttctcctttttattcattcccttcttctttagggatctttgctttgcctcttcctccagctaatcaggcttcacccctgcaccttttctgacctgctttcttctaggtcagtgattctcaacttggttatgcactgaatcacctggggagcttttttaaaaatgttgatgtttgggcccagccccagatccatgaaatcagagtatgtggaaatgatgcctaggcatcattattatttaatgtgcacctgaggttatgaaccactgatgtaggctcacctctccacctgggaaacacatacacacacgtatgcatgtacccacatgcctgtggatgtgtacacgtgcacacacaaacacaccccggcctttccccgcctctcctcccaaactcctgatatctataatactatcagacaggttgtatgtcttctaaattattattactaaattccttgtaggagccttagcatttagaatggaatttagaggtctgtactttatctcccacctcaatctgagctcttccccaaggggagggactatgattccatctccctgtggatgtccaaataggatctagaggaagactgagctaaattatcagagattcaatgacttttgtgctcttccttcctcaaagtaatattggcaatttggaggtcttcagagaggagaaacattcttcaggtatcatctttcccttttcttactgtttccaaatgtttttgcttcttctcttccctttagcttctcacctggggcgggtgggttctgcaccaccctcccaccctccttcctccgtgtggacgatagagccacatccagcaccacggacagctcccgggcgaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcacattaata

SEQ ID NO: 2417 - DNA, 473 bp, Homo sapiens
  ENST00000400991
ccagccgcaggggccacccgaacagtctctcctcctcacagaagcctggagctgggcatccaagaagaagcagcctcatttgttttctggtgtcatcgtaggtggccacctatggcttttgggaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcacattaa

SEQ ID NO: 2418 - DNA, 867 bp, Homo sapiens
  ENST00000368242
ctgcgcagaggggcccggggaaagccggcctcacgggcgggagggagaggcttgagcgaggggctagagccgcgaggactgaccagcaccagaggatacaagaggaggagagagacctcactggttcgggcgacatttcacccccccagcaccccagtcggcacagcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcacatta

SEQ ID NO: 2419 - DNA, 764 bp, Homo sapiens
  ENST00000471156
gagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 2420 - DNA, 725 bp, Homo sapiens
  ENST00000497824
gggcagcaccccctttttgctgcctttccagggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 2421 - DNA, 4774 bp, Homo sapiens
  ENST00000488498
agagacctttctcccatctccccaccaccaagcccttgttgagcacactgcacactggctttttatttttattttttggagacggagtcttgctctgtcacccaggctggagtgcagtggcgcgatctcagctcactgcaacctctgcctcccaggttcaagagattctcctgcctcagcctccagagtagctgggattacaggtgcctgccaccatgcccggctaatttttgtaattttagtagagacagggttttgccatgttggccaggctggtctcgaactcctgacctcaagtgatctgcccaccttggcctcccaaagtgctgggattacaggtgtgagccactgtgcgtggactgcgctggcccttctagtgaatgtttgggttcagggtacacgaagcagcagaatgctggcggacaccacctcagcttgcaggctgctctgggtttgatagtcagtggggctttgtccacaggaaggacaggaaaagaaggagcttttggtttttgactctggaattggacaggctggtcaggatacaaattctggcttcccccacttactagctaggtgaccttaggcaagtcccttcatgtctttggaccctaactgccttccttggttatcctgaagatcaaatggggtgatgggaatgaatgttttctaaggctgtatgcagatgtttagtgttaaatgctaagtgcagagggacacagttatggggccattgaggtaggtgggggcaatcaaggaaggcctcctgggttgtgagggccatggatcaccgggtgcagtccataacggaggcctgactgagaaatggggctgggctccatggctggggcttttgtggtctgaaggaggtgagcatcttgctgaggctgtttcgagagggacccgttgttaacaattaggtggtgaactccacaacggcagcctcttttatccactggccaggtgtgaatgccacccaacataccaggaggaggggacaggtagggtgcagctctgccacattgcccctaacctgccctgctccctccctgcagccttcatctcctcgtcctccaggcagcacaagccattgtggaatctccaccaggtgtacagaacggtgcctctgcgtcctgccactcaggacctctcaagtccccgatgtgatggctcctcagcatgatcaggagtgagcgtaattcagacctatttagatccgtcagcccacggaccagggggaccttgagcaggacagtcttttgtctccaagcagtcattccctgttatacaagcaagagtcaggaggaggaatggttttggcatcatcccccacagacagcaatggggcctttaggcctggaaggaaggaccaggctgcggctggcatatggaggttgagccctgggcacggggcatcagcttcacccggctggggatgccttctgctgggtttgtccatctggcaccagctggcttcccagcaccgcccccacaaccaaccagactcctccttctgctgttgccatggcaattggctgccatattgtacctcagagcactagctcctatctggattttcccgcggggttcctagagggtgggagatgggtctccagggatttatccctttcccctgatatctatccaataaaaattcataataacatatgattttttaatagcctaagtggaggattactatgtgtcaggctctgtgccagacactctctacatgttatttaatgtggctaagaaagaattaatgagatagaattcaagaggttcccatccagtttcctgctactacgacagacttttcctctctccaaccaggaaattccatgatcttgcttattcctgtcttgggaagtccttctccatgtctaaccaagatctatatggctatagcaccagctctttggctcttggcttggcatggctaagttgggaggtaaggaaggaatgccacctagctttagttacttcataaaggttcctggactccagctattagaataggaaaactgagacttgtctagcttggtgagaggtctgagtgccccttaaagacttgggagcccccacccaaaccttttgtttacagaagaggagtaaatgccacagaatgctttgaaattccccttctgtgccccatcagcaccccagaaagaggagccggagaccatggaatagcaatagtctctcaggccctctgggctccccctttggaagccagtctcccagctcctgccctggggggaacgttccaacagggtctcagagacatcctgggataatgagggtcccctccttctggagcccaactggaaggcagagaatggtcactttgacctcgaggggcatctataaggggcactaagcagaggccagatttgctgaggaaatcctgaatgaggagcaggtggagagaaaaaggaggccattctcaactgaggaagggtgggctgggagggaggggccagggataatttatgatatcattgctcccccgccgcacttacttcccagccctctgctactgtaccgttgctaggagagcctggctctgtctggggctgggagggtgtaacaagcgggaggctgttccatctgcactcctcctcccccacccaggggagggcaccgcatggagctgcatccaccaccccttcccaggccctgacagacaccagtctcttctgtcgttcccccaaatctagccactcaagggatagcaggactcccagttgggctgaggatctagagcaaggaatgggcaagagagcatggaaggagacacactggcagacttagaggggcactgaggaacagacagcccaccttgagtcctggcagccagcccgggtcaggaagagggccagagggggtcagggaaacaggcctggcagagatcaggtttggagaagacagggtcgttacatttgaggggctcctgatatgatgggcaaggcagacttctcatccccactcctccatactgtcaagatccaggttggagagctggcaaaggtagggggaggaggagctggggaagggaggagggatgtgagctgggagaggctgcgaagagtctaggaagaagaaaggccacactcgtctgagtggagctgggccatgcagggccgtggccgagatcccctcctctttctgaaactcttctcagatcttaaggctcttggagaagtcaagggaggtgaactttgggggtttccaaagcggctggctcccaaccctggatgggacaggaaaggaaggctgtgcccacagctgtgcctgacacctgattcctgtgcagcccctactgggtttatttgcctttcctggacatagcttccccagcccaggaaggaaggagctgaccctgatttgtgcccatttggttgtgtaagccctttcatagccattatctcagctaatcttcccaacagccctgaaaaccgggtgatattgtccccactttatgaaggaggaatcaaagcctcaggaaggctaagacactttcccagagtcacaggactggtaaattgggctgggcttcaagtgggtcttcgtagaccccaaagcatatgtccccttcctcccctgtgctgacttctgaaacacaaatggagggaccgagagaagagaggaccagataggcaggtggaattcttggcatgttctccagtgtaggggtaaagtctgagggatgataaacatcttgcaggttgaagacaggattggggaagaggccatgggagctgtggaagcgaccaaagtcttccaggctggtccttagcccaagtgcatcctgcaccctgccttcctgaagcaagtcccctgggctctctgcctaatctctcccgttcttgggatctgagtttacgccttaggcatttccctcaccccccattgccttggatggagcacctggaagaggtggaagaggtgcctagactcaagccactgtcatggtggatccctttgtgatgaccccttccctagctcctcaccttgcctgatggaagtgagctccttccaagatggctggaagtttgtcctctgcctcctcctaaagtctccatccgaagtgtattttttggctggacgtggtggctcacgcctgtaattccaacactctgggaggccgaggcaggtggatcacttgaggtcaggagttcgagaccagcctggccaacatggcgaaaccccgtgtcttctaaaaatacaaaatttagccaggtgtgatggcatgcgcctgtaatcccagctactcagaggctgaggtacgagaattgcttgaacctaggaggcagaggttgcagtgagccgagatcatgccactgcactccagcctgggtgacagagtgagattccatctcaaaaaaaagaagtatttttctttacgcttgacaatttttcttttcagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcac

SEQ ID NO: 2422 - DNA, 543 bp, Homo sapiens
  ENST00000465270
ggcagaggagggagctaggaggtgagacccgctccaccctgctcgcctaggctcggcggaggctaagagcagggcagcctcctctgcccggcgcccgctgagccccggcatctggaactcagggccctggcgctccaggggcgggaactggccgggaggaccgcgcgggagagcacggatgggcaccctgggctcgataccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcac

SEQ ID NO: 2423 - DNA, 1987 bp, Homo sapiens
  ENST00000462458
aaacggtaattcttagattgcagaaaggttaaaggctacagtttggaaagactgatagcatatgatttgtttcagaatgtaaaaagggcagctctctggcatgttcctgactgaggatctcataacatttaacttgaggaacttcctccttttccagctttgggagtcaaggtgagactcctggggacctaggtaggaagtatctgaagacttgggagaggaggcacagtccttgggaagcctgataaagggaagaggttggagtccgcgtggcagaatggccgttgttttctttctccttaatggatattaagacttattggtaacagcacttaggatgggtaaactgacttacatagataaatacagaatgtgtaaatgataatttcaagtttatgccattaagctcctggattctaagtaactaaaaacacagtttattaaattaaaggacaagttaggtagtggctataattaacaaatcctatagagacctgcctatcagcatgtagacttgtcttcataattgagtgactttaagaagggatgtcttctctcccttcgcctcacaaaccaacatccccccagtccccagtgcgattcctaaggttggtaacccaccagagtcacacaggcccctatgtctgaaagtctttcttgaagtctgcatgttcaaggtttgaaagttggaatctggttatttattttttcaccttccttcactccaatgttctgggtatggattgaccttcccacctcccttcctttgctattgggacctcagaggtcttgaggggtgagtatgtctcatccagagacagggtgtgctgacttccctaggagatcatgagtttaggttaatgctttaaaatcactggagaagcagacaaaactataaaaacattcttggggctttgaggagaatgaggagcagagttatggaaggaagggtgggtgggtgcatatttagataggagagagaaggggaaagggggaaccccctccttgccacccaggctctcccagggccaaagtgacaccccctcctcctcctgccctaatccccccattaaggcagctctgagtttgttatgacaggggctgaaggctgctgaattgctgtttgctgtgtctgctaattggactgaagggttggagtctggacactgaaagggaccattgttgctgtttaccttctacagccgcctccctggggaccctctgggtaaaggggagcagcagcacccccttagggtcattgcacccatttcctgcacaagggactgcggtggggagacagtttgtctcattgccttggggtggtttgagcttctacagcacagaggagacaagccaacacctgagccagtctcttctccaggccaggcctaggggccatccaggagctcccaggaaagaggatttacatgcttgtctttctcctttttattcattcccttcttctttagggatctttgctttgcctcttcctccagctaatcaggcttcacccctgcaccttttctgacctgctttcttctagcttctcacctggggcgggtgggttctgcaccaccctcccaccctccttcctccgtgtggacgatagagccacatccagcaccacggacagctcccgggcgaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatca

SEQ ID NO: 2424 - DNA, 726 bp, Homo sapiens
  ENST00000486517
ggcagaggagggagctaggaggtgagacccgctccaccctgctcgcctaggctcggcggaggctaagagcagggcagcctcctctgcccggcgcccgctgagccccggcatctggaactcagggccctggcgctccaggggcgggaactggccgggaggaccgcgcgggagagcacggatgggcaccctgggctcgatcttctcacctggggcgggtgggttctgcaccaccctcccaccctccttcctccgtgtggacgatagagccacatccagcaccacggacagctcccgggcgcactggaagctgagggttttgacagcggcaggccacataggcaaggaagctggtgcatgcagtgtctctgggcaaggttatgcaaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatc

SEQ ID NO: 2425 - DNA, 528 bp, Homo sapiens
  ENST00000465570
gctgcctgaccaggtgtgcactgaaagcctaccctggttggtggacatggaacagactgaggccataagaaggacttcctggctgaccagaaatactgttgaatcttcctgttaatggaattaggaagagaggatggagagagaaggaaggagggagagaccatgaatggcggcccccagaagagataccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaa

SEQ ID NO: 2426 - DNA, 688 bp, Homo sapiens
  ENST00000310027
gggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaa

SEQ ID NO: 2427 - DNA, 879 bp, Homo sapiens
  ENST00000368243
ctcctcacagaagcctggagctgggcatccaagaagaagcagcctcatttgttttctggtgtcatcgtaggtggccacctatggcttttgggaatgtaaaaagggcagctctctggcatgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattg

SEQ ID NO: 2428 - DNA, 588 bp, Homo sapiens
  ENST00000498346
cagcctcttttatccactggccaggtgtgaatgccacccaacataccaggaggaggggacaggtagggtgcagctctgccacattgcccctaacctgccctgctccctccctgcagccttcatctcctcgtcctccaggcagcacaagccattgtggaatctccaccaggtgtacagaacggtgcctctgcgtcctgccactcaggacctctcaagtccccgatgtgatggctcctcagcatgatcaggaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatatt

SEQ ID NO: 2429 - DNA, 542 bp, Homo sapiens
  ENST00000497822
ggcagaggcagaggagggagctaggaggtgagacccgctccaccctgctcgcctaggctcggcggaggctaagagcagggcagcctcctctgcccggcgcccgctgagccccggcatctggaactcagggccctggcgctccaggggcgggaactggccgggaggaccgcgcgggagagcacggatgggcaccctgggctcgatcttctcacctggggcgggtgggttctgcaccaccctcccaccctccttcctccgtgtggacgatagagccacatccagcaccacggacagctcccgggcgaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcc

SEQ ID NO: 2430 - DNA, 475 bp, Homo sapiens
  ENST00000492750
aggcttgagcgaggggctagagccgcgaggactgaccagcaccagaggatacaagaggaggagagagacctcactggttcgggcgacatttcacccccccagcaccccagtcggcacagccttcatctcctcgtcctccaggcagcacaagccattgtggaatctccaccaggtgtacagaacggtgcctctgcgtcctgccactcaggacctctcaagtccccgatgtgatggctcctcagcatgatcaggaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatc

SEQ ID NO: 2431 - DNA, 652 bp, Homo sapiens
  ENST00000357975
ccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatct

SEQ ID NO: 2432 - DNA, 412 bp, Homo sapiens
  ENST00000464238
tgacagcggcaggccacataggcaaggaagctggtgcatgcagtgtctctgggcaaggttatgcaaccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagt

SEQ ID NO: 2433 - DNA, 826 bp, Homo sapiens
  ENST00000482932
cagaggcagaggagggagctaggaggtgagacccgctccaccctgctcgcctaggctcggcggaggctaagagcagggcagcctcctctgcccggcgcccgctgagccccggcatctggaactcagggccctggcgctccaggggcgggaactggccgggaggaccgcgcgggagagcacggatgggcaccctgggctcgattgcatttgacctacctcaggatatccaaaggagaacagagggaagtgaggggttgagaactgacaccctacaacgccagcacctcagtggaaaggaggaatagagcccaggagggatgtggggcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaagccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattc

SEQ ID NO: 2434 - DNA, 427 bp, Homo sapiens
  ENST00000489918
ggaaagccggcctcacgggcgggagggagaggcttgagcgaggggctagagccgcgaggactgaccagcaccagaggatacaagaggaggagagagacctcactggttcgggcgacatttcacccccccagcaccccagtcggcacagccttcatctcctcgtcctccaggcagcacaagccattgtggaatctccaccaggtgtacagaacggtgcctctgcgtcctgccactcaggacctctcaagtccccgatgtgatggctcctcagcatgatcaggagtgagcgtaattcagacctatttagatccgtcagcccacggaccagggggaccttgagcaggacagtcttttgtctccaagcagtcattccctgttatacaagcaagagtcaggaggaggaatggttttggcatcatcccccaca

SEQ ID NO: 2435 - DNA, 578 bp, Homo sapiens
  ENST00000484428
cagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaagccttcatctcctcgtcctccaggcagcacaagccattgtggaatctccaccaggtgtacagaacggtgcctctgcgtcctgccactcaggacctctcaagtccccgatgtgatggctcctcagcatgatcagga

SEQ ID NO: 2436 - DNA, 536 bp, Homo sapiens
  ENST00000489877
gtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatccttcatctcctcgtcctccaggcagcacaagccattgtggaatctccaccaggtgtacagaacggtgcctctgcgtcctgccactcaggacctctcaagtccccgatgtgatggctcctca

SEQ ID NO: 2437 - DNA, 2697 bp, Homo sapiens
  ENST00000476966
ggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaaggtggaacagactgctacctctgtctgaagtggtttggagggaaggcctcagggacagggcatacctagcagtagctggcaagcccatgggagaaaaggcaagggggcaaccatctgccagggcacagaggccaggggatggccacaaggagtctccagaggccagtgggagtcatgcaaactggaacggggcctgggaaaggcccttctgtgtgcccaggcctgcctccccaacaccgtgagcctagaaacaaaggggccattctctctaggatttgatgctgccatctccggctggcagtgccaggtggtgggggcatcgggggtgtcaatccattatcccccccaactcctaggtcctctgaggctggatgttggggaggtgggtgttctatgctatgttgctatggcaaccgcccccccacccccaaagtacaaagagaggcagctttcacccctacccccaggaagaacctgggtctggctgggaatcttcccttgagaatcctcctttctgatgcacaagccatggcatgcataagcgtcaccctcttttcagcactggaagctgagggttttgacagcggcaggccacataggcaaggaagctggtgcatgcagtgtctctgggcaaggttatgcaagtgagtaccagccccttatacttaaccccctctcttcccaagctcgcctgcccctcacctaccacagccaaggacatcccaggccttctcagctgaagcgatggggccttgaccttctactctttcccagaagtgagggacacccggctacctccagcaaacctccaggctgtgggaacagagaagaggagggggccattcctgccaccctccatctgcaccctccgccattactcattaggcattctgccccctccttccgctcgttaagcctgatttgcatgcatttgcataatacagttcatttacattccaggaggctcatggtagaagccaggaaaaaaggggaggggggctggagaagagaaaaagggggagagattttgttttcatcaaagtgttgggggagggactagggggaggtggcaggaagaggacagaaataaaaacttacactactttctttcttcctttctgccctccctccctgagctggactcaaatgccaaagagagatgccaaggggccagcttttctgtccttttttgtcttgcttcctccggccttggctccccagcctggccccccaccttgttgggctgaggcttcagaaagaaagaggcaggggtaggaggcaaggctgtgggaacggaagcggagggtgagggaggccgccatcttaggtaactggcgcctgtaagatggctgcctgaccaggtgtgcactgaaagcctaccctggttggtggacatggaacagactgaggccataagaaggacttcctggctgaccagaaatactgttgaatcttcctgttaatggaattaggaagagaggatggagagagaaggaaggagggagagaccatgaatggcggcccccagaagagatgtaaggttgagcacaggagcaggggtggtagagaggcctcagcactgggcttagttcccagactacttagaggactgtgggtaataagaaaagtactggaggaatcagaatgggggaatatcagcatgaggagagagagagtaagatgtggccaggcagtatcatctgctagtttgagggtctctctggggcctgtgaaaggtgactgtgtacttgaggtgatgctccaccttctctcctcagcccagcactctggtgaaactgcatcctctcagaggccactcacagccccctcaacaaagaccactggcccttcccaagcccagtcctccttgacctgtatggaaaatgttatgccattttctcagtcttttcctttggccttctgttcttctgttacatccatgatcatctgttcttggttccattcattcagtcctccggatggaccagttccttaactagaagtggtccccaggttctgctggtagcttgttttctcttccttctcactcttctcactccacttttatcactttaaccatcacctgaagttataaattctcctgtgtttcatttttcttttcttttctcttctctttctttctctctctctctctttcttctttcttttttttttttttttttttttgagagtcttgctctctcacccaggctggagtgcagtggc

SEQ ID NO: 2438 - DNA, 685 bp, Homo sapiens
  ENST00000463309
cagaggcagaggagggagctaggaggtgagacccgctccaccctgctcgcctaggctcggcggaggctaagagcagggcagcctcctctgcccggcgcccgctgagccccggcatctggaactcagggccctggcgctccaggggcgggaactggccgggaggaccgcgcgggagagcacggatgggcaccctgggctcgatcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaaggtggaacagactgctacctctgtctgaagtggtttggagggaaggcctcagggacagggcatacctagcagtagctggcaagcccatgggagaaaaggcaagggggcaaccatctgccagggcacagaggccaggggatg

SEQ ID NO: 2439 - DNA, 766 bp, Homo sapiens
  ENST00000464203
gaaaggatgaatgaaaagtccggagccggagcgcgccggggccagagccgcggcagaggcagaggagggagctaggaggtgagacccgctccaccctgctcgcctaggctcggcggaggctaagagcagggcagcctcctctgcccggcgcccgctgagccccggcatctggaactcagggccctggcgctccaggggcgggaactggccgggaggaccgcgcgggagagcacggatgggcaccctgggctcgattgcatttgacctacctcaggatatccaaaggagaacagagggaagtgaggggttgagaactgacaccctacaacgccagcacctcagtggaaaggaggaatagagcccaggagggatgtggggaatgtaaaaagggcagctctctggcatgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaa

SEQ ID NO: 2440 - DNA, 1575 bp, Homo sapiens
  ENST00000469813
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggctttcggcccctgattttggtctactccaattgtagaaagacctacatagtcaatgataggccaccctgcttccagttctgtgatagagaggaaaggcattggggatacagggaactctttccccttctccaatgggctcctgagggcaaagttggaggccaattgaccttgggggagatgattggttggagaagggaacagagatacttgtacctgggtgacagaggtgagaaagaagaggagcatggggtatggtaaatggggacccaaggagcttaaataactgtgagtgggtatgtatgccagggtatacaactgcaagcactgggaggtggtactgctgggagtatcagtggatttgtcattgcattggtctgagttgataagtttgagtatgtgtgcatgtgtgtgtgtgtgcgcacgcgtgtatgtgtgtgcgtgtgtgtatgtgtatgtgtgtgcatgtgtgtgtgtgcgtgtgtgtgtgtgtgatgcgcagcacccttgcatactcatgcttatgccccttaaggaggccatttgctgatggttgagggtcttgtagaaaggactcagtctggacgaaccagccaaccctctaccatctctgccaccttgttcttacctcccagacacataaggttctcaggcaagtgagcaatgtgtgggctcaagaatagaactgggagcaggcaaggaaggcagtacttacacaagcccaaggaattctcaagctggcccctcaataggaggaacataccactctctcgtggggaagaagtgtgacatccttagggacgatatcctccagattatttctccatacctcctaccttttctgcccacatgaatagatattttgtatatatatatttttttcacacagcctcagtattttttattgctaattcttgcttttatttgtgactatcccatagacaatgcagatttctatagcaaaaaatgtatgatattgttcataatgatgcacttataagacaaataaatatctgaatccaccctttcccaaa

SEQ ID NO: 2441 - DNA, 1091 bp, Homo sapiens
  ENST00000495000
cgcaggggccacccgaacagtctctcctcctcacagaagcctggagctgggcatccaagaagaagcagcctcatttgttttctggtgtcatcgtaggtggccacctatggcttttggggtatttattttcttatttattgtttctgatggtggagtgggtgggggaagaaaaggaaaactggccctgtctcacttatgttttctcctgttctctgtacccctctacccctctccctgtctcttccagctttcggcccctgattttggtctactccaattgtagaaagacctacatagtcaatgataggccaccctgcttccagttctgtgatagagaggaaaggcattggggatacagggaactctttccccttctccaatgggctcctgagggcaaagttggaggccaattgaccttgggggagatgattggttggagaagggaacagagatacttgtacctgggtgacagaggtgagaaagaagaggagcatggggtatggtaaatggggacccaaggagcttaaataactgtgagtgggtatgtatgccagggtatacaactgcaagcactgggaggtggtactgctgggagtatcagtggatttgtcattgcattggtctgagttgataagtttgagtatgtgtgcatgtgtgtgtgtgtgcgcacgcgtgtatgtgtgtgcgtgtgtgtatgtgtatgtgtgtgcatgtgtgtgtgtgcgtgtgtgtgtgtgtgatgcgcagcacccttgcatactcatgcttatgccccttaaggaggccatttgctgatggttgagggtcttgtagaaaggactcagtctggacgaaccagccaaccctctaccatctctgccaccttgttcttacctcccagacacataaggttctcaggcaagtgagcaatgtgtgggctcaagaatagaactgggagcaggcaaggaaggcagtacttacacaagcccaaggaattctcaagctggcccctcaataggaggaacataccactctctcgtggggaagaagtgtgacatccttagggacgatatcctccagattatttctccatacctcctaccttttctgcc

SEQ ID NO: 2442 - DNA, 768 bp, Homo sapiens
  ENST00000615748
atgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcac

SEQ ID NO: 2443 - DNA, 7705 bp, Homo sapiens
  ENST00000366788
gagctcggcgcggagcccggagcccgcagccgacagtctcctgctcccgtacgctgggcgccagctccggccgtgctgcccggctgcctgagagcgcgcccggccatggagccctcgcacaaagacgccgagacggcggcggcggcggcggcggtggcggcggcggacccccggggggcgtcctcgtccagcggggtggtggtgcaggtccgcgagaagaagggccccctgcgcgccgccatcccctacatgcccttccccgtggccgtcatctgcctcttcctcaacactttcgtgccgggactggggacattcgtctcggccttcactgtgctgtgcggggcccgcaccgacctcccggacaggcatgtgtgctgcgtcttctggctgaacattgcagcagccctcatccaaatcctcactgccatcgtcatggtgggctggatcatgagcatcttctggggcatggacatggtcatccttgccatttcccaaggctacaaggagcagggcatcccacagcagctgtgagcccacgggagccgctggggagatccaggggggccctgtgagggctgcaccaggcagctttgggcacaaggacctttacatgttcttttctgccattttctggactgggggtggaaagggggtatttttaaaaatattatttattttgaaaacgcatctgcttttctcagcaggttgtgagggctgccagcccctcctgctctggaaagcactgtgggcgcaggcaccagagcatcagagagtggggtggagatgagaacgcccacagagaggctgggatgctccggcaggctccaactggccttgctgtacccactgcccaccgcaaaggcacgccacgtctgctgggccgggccacaccgggccctgtctgggtgagcaggggctcaccaaggggacaggactgtggtagacccgtcctgtgggaccccacctgcctcaaaatctggtgccccgagtgtttactgtgtggtctcctgggggcagcaccagggtgtgggtgaggatggccaggctccaccctagcgtggaaaggcccactgtgcccacagctggcctgaggcctcggggagaagaccagtcccacaggcgtctcctgggcctgcctccctgaccgcaccccccgcctcctcgcagctgaaatctgagggctgggtgtgtcgtgacctgtgttttcctgggaaggagaggagtagctccttccctggggtgaaactgccagatgtttatacacaaagttattagactgaagcaggagtgggcagactagcaggctttcacccaatacttaacagcatttctggcccacattcctttttctgaagtcattggggccagatgtgtctccgaattgagaaattttagatttgagaaagacaatgcgatccatttatcgtacactttctaacttcccggcagagtgtggaacatctcgcctaccatcaggcacgtgaatatttctgcagagaaacatgtgactagtcccattaactgggagctatacaaactgtaaatagcctcacctcagttcagtctaattttgccactaagtaacttagggaaaaacttaccatttgagagcttttagggtttcagaattgcaagaacaattgtatggggttgtggaccttgatctgaaaatcctgcttgcaaacagatgtgttagagggtgaaattgtcggcattacacaaggactccttcagttgccaaaagaccatgggcctctttaaggagcccctctgtaagtgattgggacagggctagatccctaatgggggctaggggtggggagaatctagcagaagttgtccaggatactgtggatcaagtatcaatctgaaattaagagaaattagatactaagaggatggacatttacatgtctgtttcctttcctttcattttcattctaacataggaaatgctaacagatggggctggcccaaagtcaagcttctgactccacttgacacagtgccattgggcatgtccctctctgaagggcttgtttgtctatcagagactgtcagaactccatgagggcaggagaagggattttgcaggatgaaagtgcttgggaagtagtggccaccgttctgggggtttcagcccacctaccccatccaccgggctttctaatcacagtcctgcctgagaagcgggccctgctgcccaccccttatcatggatcccttagctactgtccgtcttccattgctgcctggggctgggctgccgtttttgaacacctggcagtgtctttgtcgcgtcctgtcctctcttcttacagaccccaacccaggcctttgccttcttctctcctgtttggaagcctctgtatcttcaaggtgtgggaacagatttggttttctctaaaaagctagaaccttctgctgtgtgcagcaggcatcctccaggctggtgctggctgctctcgaggaagctgcgtcagagtggagctgcccctctactcagataaaatagcttcagctgcaggaagccgccccctcccatgcccaccagcccacagcccttcaccccacacagcccccagagtttgcccgacaccccctgagtgatgacaggtctcaggagggggccgcccccacaaatgggaggcggaagcttattttccccgcttgggctgggggcggctgctgagggggtgaagaagagatagcaatttatgtcgcatgtttagtgacacaatccagatgcaggtgggactttcttgagtggcaggtgtcaccctgggtcccgtgtgggatggtttaatacaggggtttgtgtgtttgtgtgtgtggagggccactgcgcccccagatcctcctctcccccgagggctgcgtctctaaacctgggaaaacatcagcctcaggaggaggcccctttccgggtaactgatgtgtgggagaagccaagaggcccctgcctgtctcctgaatgaggctgtgagggttgccatgtgggcgggaccggttcaaaatagcgcccccgcccctctaaattagaccgtggtctcagcatgatcatcttcagtagataagggacagtggctgatttactccaaatagttccagctggccactcagaccagggccagagttaacttctcaaacaccagccagctgaaaattagggttctcgtgcaggcaagtgcatggttgacacacagccctttggtgacaaagctgggctttgcctgcatagtgcagacaaggctgttggttcagaggctgcagggcacattccaggttggggccttttgtcggtcggaattcaataggacattccctggctgtgggtgtttagggcaggaattacaggcttgcagagaaagtcagaggcaatgagatgctcccagtaccaaactgtgacactgggatcagggtggtcattcccttgggtcagagtgggaccctagagccagagtgagctgtgggtggcctgggtgtgtcctgtggacggcggagactgttgatttggatgttgagctctgagtcagtttcagaaccaaggatctcaggctgagaaggccaggtccccatgggagcggcaggagtctgatggctctgctgccagagcctaccccagcctgccacgccgctgaccttcccatggtaaggaaggggcaggcagcatggttcccaccctcagctgccccagacccacacatccagccccaagagcagcctcacccaggcacagtgcagggcattttagctcctgggaggggagatgcctttgtgagtttcagatgtcagaggagaagctccgagagagtaagtcatgtgcccccaaacactcagctcctaagtggcaggacaggcaagtggccaggttgggccgcccccacagcctgtgccgtccacacactcactacagcactcccagaagaaggagcagaatcgcatgcagcccagagcaggtcctgtggaggggtcctcacccctcaggagtaatagggtgattatgtcacatgtttagtgatacaatcccacctgtgtctggattgtgtcactaaacatgcaacataaattaccatctcttctccatcccctcagcagccgcccccaccccaagctgggaaaataagcttctccctcccatatgtgggggcggccccctcctgagacctgtcatcacttagggggagttgggcaaaacctcctaggaaggtcctggacgcctccaccctgccccacaaggctccgtactcccacctgcctgggcagccctcacacccatgctccctcctttaggcaggcccagaaaggtgccccttcctgagggtgttgggggatggcggcagagagacagctggtattaggagcttccccatcctaatgtgcaggaccaagttgcccgctctgccagccaggggctccagccatgctggcacaggcatctcagaggtgtgagatgaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcagcacaaagtgggtctgaaaccccaggaccgggtcaaaggccttccgaaggcccgaggttcttgaggaggggaagctgatagggccctggtctttctgcaccagcgtggctctttaaaatacaaaacacccacaaagccaaaaaccctgaaacatgttctttagctaaccccttccctgcccagatgcctgcaattctgagaattcacttcagttttgccagatccaacccctaggcttgagggtggagagccaggcctcctcagggtcccttctaggctcccaggcccaccttaggctttaattgcattggctgtttcttatggtgttagtgaattttgcaaagaaagccctgagcattgcataaatgcttgggggcgtgtcatttaaatggaagttctccaatagtggctgaaggcagagtttactgttatccctccctcttgctggctttgctggagggcttttatcagagagattggaggtgggagagcacttttaaagcacaccccaccccctgcacccgagcggcacctaagcttcccagagaccatgaccttgtatgtggctggaggcctcaggcttagggagcagcctgaagcctttgctgtcaaccctcccaggaaagaagccgggcctcaggctgaggaaaaacagagtttcctctccagagggctcaatgagcagccaggtagtggcctcgggcagtcctcaccagggggacacctccctgctttgcattaactcatcagcaagctcatcgagagctaacgtgggcccagcagtcctgtgcttggaaatgatgccgtcacctccacactcctgctgttccagcctctgcaggtgaagctgcaaggtgagcagaggcaggcgtggggacacactcttcaaggactgcactgccccttctccctcctgagagctctgtgcactgggtttggggatgaggcgccagcctggtcaggggaggtgactgtggtccttctgaccagcttggatctttaaaataatcacaaaaaagctcagcctgagcaggtgggtgcaaggctcaggggcctgtgtttttcatcaatcagttttcttcctgcaagattcttagagctggatgttcacgggatcatggggcatggaggtggtcacgctcagacagtcatgcaccaccctcaatcccaggccctgcagagataggaagaatcccaaccagagggattcttccccaaacgttcccttgtggcccaagagtgagttccggcctgagtgctgttatgactgccggcgtctctccgactgcctctcgcctcagtttaaccatctataggttaggaacaaagaagggcttaggcagccatcgtttccccatttctgtcagagccaagggcttggaggcccagccccatccgggcaagggctgtccgctcctgcccaggcctcacctcctcgctgcagctggcaagattctttctagcagaacagaaacactggcccccaattccactctcccctcctgatgctaccgcagagggcagaaaggtgccctgtagcgtccaccatgtgtgtgtcctgagtttccagtgcaagtcatctggatttgcatttagctagggaaactcggccctcaaaccctctccctctctgcctgaatttgccaaaatgccaaccatccgggcaggtgtggatgccacagtccatccccattgcatttcacccccacatggacagaggcacacactcgcacacattcccagcacctttgactgctgggggatgcaggccagggtctgcctggagcctcagggttgggacttatctccaaaggagcccacaccccctcttccaggatgggcactggctggcagcacttttttccctcatcacatccctgacccctgcccagcccacatgcacatgctgtttcctgtctccagggccctagcctgtggatctcttcctcccatgcactcctagggtgaatgggctcagcaccaaacctggctgtgcccattccccacaaccccagcttggcctcctgtgggaaggagaaggcagacctgcccagaggagaggggcagtgttcccacccacctgctccagcacaggaaccagggaggaaagaagggagagggaggttccattcaccgttttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggttctgtgtgtatcaacttaatttgcatatgaatgagtgttgtgttgtgatttgcagtgttttgacaccgtgattggctttgtttgggtctctcttctttctgtgaaattaactgctgtgcgttttcactgttcttagagaagaccctgagctcctggggttttcttgtctcacttctaccctgacctgctgggagcccaccccaccccagtccagccatgagggtatttccagcctattccaatgactgaaacccttcttggaagaaaacgtctaatgtcggggacgtagggacgcttccagacttgccctggccggaaccctgcagcctggggccccagcccgcctgcagctcagctttccccaacaccctcaggacccagccccagccccggcagaccttccctgggagctgcttaggtggtctccacagcgccctctaggggccaagcagggttccagattctccagccttctgccagctttaaaacccttcactcaagcagcattactgtacatgcaatgaaaaatactatatatgacagtcaaaacctgtgtacatatttccatgtacatatttatacatacacacaccttcctattataaatatataaagcatgacatctctttggcattccaagtttgtgtttttttaaatccttggaaatacggctttggaaacctttttcttcctttccctcttttctatgttgtaataaacattcatgtgaccttt

SEQ ID NO: 2444 - DNA, 275 bp, Homo sapiens
  ENST00000467495
ctctgttttcaggctgtgttttctcttcttctctctctcctcttcctcctgctgcctcccactctgtgctgctgcagtttcccaaggctacaaggagcagggcatcccacagcagctgtgagcccacgggagccgctggggagatccaggggggccctgtgagggctgcaccaggcagctttgggcacaaggacctttacatgttcttttctgccattttctggactgggggtggaaagggggtatttttaaaaatattatttattttgaaaacg

SEQ ID NO: 2445 - DNA, 4093 bp, Homo sapiens
  ENST00000366789
gagctcggcgcggagcccggagcccgcagccgacagtctcctgctcccgtacgctgggcgccagctccggccgtgctgcccggctgcctgagagcgcgcccggccatggagccctcgcacaaagacgccgagacggcggcggcggcggcggcggtggcggcggcggacccccggggggcgtcctcgtccagcggggtggtggtgcaggtccgcgagaagaagggccccctgcgcgccgccatcccctacatgcccttccccgtggccgtcatctgcctcttcctcaacactttcgtgccgggactggggacattcgtctcggccttcactgtgctgtgcggggcccgcaccgacctcccggacaggcatgtgtgctgcgtcttctggctgaacattgcagcagccctcatccaaatcctcactgccatcgtcatggtgggctggatcatgagcatcttctggggcatggacatggtcatccttgccacttccacaggctacaaggagcagggcatcccacagcagctgtgagcccacgggagccgctggggagatccaggggggccctgtgagggctgcaccaggcagctttgggcacaaggacctttacatgttcttttctgccattttctggactgggggtggaaagggggtatttttaaaaatattatttattttgaaaacgcatctgcttttctcagcaggttgtgagggctgccagcccctcctgctctggaaagcactgtgggcgcaggcaccagagcatcagagagtggggtggagatgagaacgcccacagagaggctgggatgctccggcaggctccaactggccttgctgtacccactgcccaccgcaaaggcacgccacgtctgctgggccgggccacaccgggccctgtctgggtgagcaggggctcaccaaggggacaggactgtggtagacccgtcctgtgggaccccacctgcctcaaaatctggtgccccgagtgtttactgtgtggtctcctgggggcagcaccagggtgtgggtgaggatggccaggctccaccctagcgtggaaaggcccactgtgcccacagctggcctgaggcctcggggagaagaccagtcccacaggcgtctcctgggcctgcctccctgaccgcaccccccgcctcctcgcagctgaaatctgagggctgggtgtgtcgtgacctgtgttttcctgggaaggagaggagtagctccttccctggggtgaaactgccagatgtttatacacaaagttattagactgaagcaggagtgggcagactagcaggctttcacccaatacttaacagcatttctggcccacattcctttttctgaagtcattggggccagatgtgtctccgaattgagaaattttagatttgagaaagacaatgcgatccatttatcgtacactttctaacttcccggcagagtgtggaacatctcgcctaccatcaggcacgtgaatatttctgcagagaaacatgtgactagtcccattaactgggagctatacaaactgtaaatagcctcacctcagttcagtctaattttgccactaagtaacttagggaaaaacttaccatttgagagcttttagggtttcagaattgcaagaacaattgtatggggttgtggaccttgatctgaaaatcctgcttgcaaacagatgtgttagagggtgaaattgtcggcattacacaaggactccttcagttgccaaaagaccatgggcctctttaaggagcccctctgtaagtgattgggacagggctagatccctaatgggggctaggggtggggagaatctagcagaagttgtccaggatactgtggatcaagtatcaatctgaaattaagagaaattagatactaagaggatggacatttacatgtctgtttcctttcctttcattttcattctaacataggaaatgctaacagatggggctggcccaaagtcaagcttctgactccacttgacacagtgccattgggcatgtccctctctgaagggcttgtttgtctatcagagactgtcagaactccatgagggcaggagaagggattttgcaggatgaaagtgcttgggaagtagtggccaccgttctgggggtttcagcccacctaccccatccaccgggctttctaatcacagtcctgcctgagaagcgggccctgctgcccaccccttatcatggatcccttagctactgtccgtcttccattgctgcctggggctgggctgccgtttttgaacacctggcagtgtctttgtcgcgtcctgtcctctcttcttacagaccccaacccaggcctttgccttcttctctcctgtttggaagcctctgtatcttcaaggtgtgggaacagatttggttttctctaaaaagctagaaccttctgctgtgtgcagcaggcatcctccaggctggtgctggctgctctcgaggaagctgcgtcagagtggagctgcccctctactcagataaaatagcttcagctgcaggaagccgccccctcccatgcccaccagcccacagcccttcaccccacacagcccccagagtttgcccgacaccccctgagtgatgacaggtctcaggagggggccgcccccacaaatgggaggcggaagcttattttccccgcttgggctgggggcggctgctgagggggtgaagaagagatagcaatttatgtcgcatgtttagtgacacaatccagatgcaggtgggactttcttgagtggcaggtgtcaccctgggtcccgtgtgggatggtttaatacaggggtttgtgtgtttgtgtgtgtggagggccactgcgcccccagatcctcctctcccccgagggctgcgtctctaaacctgggaaaacatcagcctcaggaggaggcccctttccgggtaactgatgtgtgggagaagccaagaggcccctgcctgtctcctgaatgaggctgtgagggttgccatgtgggcgggaccggttcaaaatagcgcccccgcccctctaaattagaccgtggtctcagcatgatcatcttcagtagataagggacagtggctgatttactccaaatagttccagctggccactcagaccagggccagagttaacttctcaaacaccagccagctgaaaattagggttctcgtgcaggcaagtgcatggttgacacacagccctttggtgacaaagctgggctttgcctgcatagtgcagacaaggctgttggttcagaggctgcagggcacattccaggttggggccttttgtcggtcggaattcaataggacattccctggctgtgggtgtttagggcaggaattacaggcttgcagagaaagtcagaggcaatgagatgctcccagtaccaaactgtgacactgggatcagggtggtcattcccttgggtcagagtgggaccctagagccagagtgagctgtgggtggcctgggtgtgtcctgtggacggcggagactgttgatttggatgttgagctctgagtcagtttcagaaccaaggatctcaggctgagaaggccaggtccccatgggagcggcaggagtctgatggctctgctgccagagcctaccccagcctgccacgccgctgaccttcccatggtaaggaaggggcaggcagcatggttcccaccctcagctgccccagacccacacatccagccccaagagcagcctcacccaggcacagtgcagggcattttagctcctgggaggggagatgcctttgtgagtttcagatgtcagaggagaagctccgagagagtaagtcatgtgcccccaaacactcagctcctaagtggcaggacaggcaagtggccaggttgggccgcccccacagcctgtgccgtccacacactcactacagcactcccagaagaaggagcagaatcgcatgcagcccagagcaggtcctgtggaggggtcctcacccctcaggagtaatagggtgattatgtcacatgtttagtgatacaatcccacctgtgtctggattgtgtcactaaacatgcaacataaattaccatctcttctccatcccctc

SEQ ID NO: 2446 - DNA, 1143 bp, Homo sapiens
  ENST00000374642
agtcttgctgaagtctgcttgaaatgtccctggtgagcttctggccactggggaagttcagggggcaggtctgaagaaggggaagtaggaagggatgtgaaacttggccacagcctggagccactcctgctgggcagcccacagggtccctgggcggagggcaggagcatccagttggagttgacaacaggaggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaa

SEQ ID NO: 2447 - DNA, 768 bp, Homo sapiens
  ENST00000438241
ccaggaggctgggcagctgaggcagggagggagggaaataactgtgcctgattctaggacagggatgggggtgcagcactgatccaggacccagaatggaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccc

SEQ ID NO: 2448 - DNA, 976 bp, Homo sapiens
  ENST00000402322
acctgcccaggccctcccgtgtctccacagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaa

SEQ ID NO: 2449 - DNA, 677 bp, Homo sapiens
  ENST00000510260
agcaggtacaattatggtcccatcctatagcagagaaaattggggctcccttgactgacaacacatcaactggcaagtggcagaggcgggattggaatcaaaggctctgactgtaagccagcactcaggcagcgggcccgccacatgatgctcactgaggaacacccctgcccagtgtagaagaagatcacgaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagcccc

SEQ ID NO: 2450 - DNA, 1254 bp, Homo sapiens
  ENST00000509305
gtggatgttcccccaggacagcgtgttctccccacagctgctgagttggcagaaccaaacttgccacccacccgtctcatttacagtaaatccagtgggttgcagaaataggacctgaaactgcctgagggcagcagggtggggggacagtgaggggacgggaaaggggccagcctgctggtccatgggaggggaccgtcaggggaaagcccttcccgcctctggggaagggaacttccgcttcggaccgagggcagtaggctctcggctcctggtcccactgctgctcagcccagtggcctcacaggacaccagcttcccaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccaaccaatgcacacagtagggcttggtgaatgctgctgagtgaatgagtaaataaactcttcaaggccaagggaca

SEQ ID NO: 2451 - DNA, 977 bp, Homo sapiens
  ENST00000432749
gcccttcccgcctctggggaagggaacttccgcttcggaccgagggcagtaggctctcggctcctggtcccactgctgctcagcccagtggcctcacaggacaccagcttcccagccctgtcaggttgaaatcagcattgccaagaggctcagagaggttaaggcacttgcctgaggttatgcagccggtagcagatggggctttaaagtcaagtgggcctgactccatgttgcggaaagggactgctggaccgaaggagatggaaaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactc

SEQ ID NO: 2452 - DNA, 1044 bp, Homo sapiens
  ENST00000314933
gcccttcccgcctctggggaagggaacttccgcttcggaccgagggcagtaggctctcggctcctggtcccactgctgctcagcccagtggcctcacaggacaccagcttcccaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccaaccaatgcacacagtagggcttggtgaatgctgctgagtgaatgagtaaataaactcttcaaggccaaggga

SEQ ID NO: 2453 - DNA, 1295 bp, Homo sapiens
  ENST00000253407
tagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccggcacctactttttcacctaccatgtcctcatgcgcggcggcgacggcaccagtatgtgggcagacctctgcaagaatggccaggtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatctactccgactgagctccccacgtctccctccacccacgtccctcacccgccggggtcccctccgggcggggcagacgatgactcgcccctcgcccacccgctcgctgcccggccctccccggctatgacgcccccggcccgtgctcaacaccgcctgggccacagctaggccctcccaccggctcgctgcagagccgggcccagcgcgccctgtccccgtgccagggaaccggggttgaccgcccccgcccagcccgcgctatatatttgtacaataggactgtttactgcccacctccgcctgccagcccaccccagcctggggagaggtcgcggcggcgggtttgcttcctgcgctctgagatgagctgccctccgctccctccggggtggcgcgcccgggggaggggggagttgggggctggatagcttcccagcaccctcagagcccccgcccggctgtgccccgtctgaccaaagttataataaaaacattttcaccccgca

SEQ ID NO: 2454 - DNA, 2043 bp, Homo sapiens
  ENST00000272520
gacatgagggctccgtctcccgagtgatggcagcgcgcgctgcttcgccgcctccgccgctcagccccggactccttacgtcagggtagcggggtcccccctccgcgcgggagccagcgaacagcgagagagcacagcagagcgcgccgcggagccggggcgccctcactgcgctaggagccccactaaacccagcggagcggagcctggcgggaggcagcgccgcggagccagcgccggacgccgcaagcagactccccggccagcgcaagcactccctggccggcgccggaccctcggggcgccggattcgtcttgtgtgccccacgtcatgcgcgcgggcgtccgcggctctcccgaccagccccagcgcggtgggcccaggctcagaggtcccggcgcctctcgctgaagtagttgggtagccggggctgggggtcgccacgtcgggggcgcggccaggacccgcggagccggtccccgagcgcggggagcggggccgcccgcgccgccccaccattacctccccgggcggcaaggaggagctggtggcggtcgcctcccggctgtggcagcggcggcggcgtgcctgcctggcggccgtcggcgtactcttggccatggcgctcgggctgctcatcgccgtgccgctgctgctgcaggcggcgccccgaggcgccgcgcactatgagatgatgggcacctgccgcatgatctgcgacccttacactgccgcgcccggcggggagcccccgggtgcaaaggcgcagccacccggacccagcaccgccgccctggaagtcatgcaggacctcagcgccaaccctcctcctcctttcatccagggacccaagggcgacccggggcgaccgggcaagccagggccgcgggggccccctggagagccgggcccgcctggacccaggggccctccgggagagaagggcgactcggggcggcccgggctgccagggctgcaactgacggcgggcacggccagcggcgtcggggtggtgggcggcggggccggggtaggtggcgattccgagggtgaagtgaccagtgcgctgagcgccaccttcagcggccccaagatcgccttctatgtgggtctcaagagcccccacgaaggctatgaggtgctgaagttcgatgacgtggtcaccaacctcggcaatcactatgaccccaccacgggcaagttcagctgccaggtacgcggcatctacttcttcacctaccacatcctcatgcgcggcggcgacggcaccagcatgtgggcggacctctgcaagaacgggcaggtccgggccagcgccattgcacaggacgccgaccagaactacgactacgccagtaacagcgtggtgctgcacttggattcaggggacgaagtgtatgtgaagctggatggcgggaaggctcacggaggcaataataacaagtacagcacgttctcgggctttcttctgtacccggattaggggcgcggggggtgcgaggcggggtggctgcaggccgcccggtctccgcccgggcgcggctccttggcaaaggccactctcgattcataacacttcctgacatctcctttggaaaagacaaatccctgcgtcctccctgccccgctcctggcctcagtgcgtctgcgacccaccacgctcagggctgtgctcctggtctccatccccatcccggcaagggaggaagggacgcccgagcccttgaggcggcggcacagactttgcaaacctgattagactggacaggcagggccgggagcctgccctcctcagacagcctcctcccagtgcctagaagcggagggctccgggccctggccagggaggtaggccagagggagcgcgggcttcctggggcgtccttctttgtgacccgaaatacttgtgcagatttccctgtccatcagccaaaaccccacccacagcagaattccagcaaacagaaaattcacctctccacaccgcattccctcctgactcagactcaccgcgatgcattaaattatgtttttagactatg

SEQ ID NO: 2455 - DNA, 1664 bp, Homo sapiens
  ENST00000302514
aggaaggaagctggactgtagagcgctctgggccaccccgcgttagctgctgcctctggcctcagtttccccaactgctcagattaatgatgcctgctctctagacccagaggacgaagctctaaggaggtcacagatgaggaagggtccagtgctcggcgcagactccgtgcggagcccctaggccccgcagctcgcccctccctctcccctactcccctcctctccccctcccgtctctcccccgcctcttcgctctcgctcggctccctctctagctgaccttccctttccctcacgcctccccacgcccggcccctggccccagcaccctgtccgctgccgcctcagagccgggaaaagcagccggagcccccgccgcccctgccgcagcgcgggcggtcagcgcgcagcccggcacccgcagcctgcagcctgcagcccgcagcccgcagcccggagccagatcgcgggctcagaccgaacccgactcgaccgccgcccccagccaggcgccatgctgccgcttctgctgggcctgctgggcccagcggcctgctgggccctgggcccgacccccggcccgggatcctctgagctgcgctcggccttctcggcggcacgcaccacccccctggagggcacgtcggagatggcggtgaccttcgacaaggtgtacgtgaacatcgggggcgacttcgatgtggccaccggccagtttcgctgccgcgtgcccggcgcctacttcttctccttcacggctggcaaggccccgcacaagagcctgtcggtgatgctggtgcgaaaccgcgacgaggtgcaggcgctggccttcgacgagcagcggcggccaggcgcgcggcgcgcagccagccagagcgccatgctgcagctcgactacggcgacacagtgtggctgcggctgcatggcgccccgcagtacgcgctaggcgcgcccggcgccaccttcagcggctacctagtctacgccgacgccgacgctgacgcgcctgcgcgcgggccgcccgcgccccccgagccgcgctcggccttctcggcggcgcgcacgcgcagcttggtgggctcggacgctggccccgggccgcggcaccaaccactcgccttcgacaccgagttcgtcaacattggcggcgacttcgacgcggcggccggcgtgttccgctgccgtctgcccggcgcctacttcttctccttcacgctgggcaagctgccgcgtaagacgctgtcggttaagctgatgaagaaccgcgacgaggtgcaggccatgatttacgacgacggcgcgtcgcggcgccgcgagatgcagagccagagcgtgatgctggccctgcggcgcggcgacgccgtctggctgctcagccacgaccacgacggctacggcgcctacagcaaccacggcaagtacatcaccttctccggcttcctggtgtaccccgacctcgcccccgccgccccgccgggcctcggggcctcggagctactgtgagccccgggccagagaagagcccgggagggccaggggcgtgcatgccaggccgggccggaggctcgaaagtcccgcgcgagcgccacggcctccgggcgcgcctggactctgccaataaagcggaaagcgggcacgcgcagcgcccggcagcccaggc

SEQ ID NO: 2456 - DNA, 530 bp, Homo sapiens
  ENST00000530097
atgctgccgcttctgctgggcctgctgggcccagcggcctgctgggccctgggcccgacccccggcccgggatcctctgagctgcgctcggccttctcggcggcacgcaccacccccctggagggcacgtcggagatggcggtgaccttcgacaaggtgtacgtgaacatcgggggcgacttcgatgtggccaccggccagtttcgctgccgcgtgcccggcgcctacttcttctccttcacggctggcaaggccccgcacaagagcctgtcggtgatgctggtgcgaaaccgcgacgaggtgcaggccatgatttacgacgacggcgcgtcgcggcgccgcgagatgcagagccagagcgtgatgctggccctgcggcgcggcgacgccgtctggctgctcagccacgaccacgacggctacggcgcctacagcaaccacggcaagtacatcaccttctccggcttcctggtgtaccccgacctcgcccccgccgccccgccgggcctcggggcctcggagctactgtg

SEQ ID NO: 2457 - DNA, 1038 bp, Homo sapiens
  ENST00000539803
acaaccctgccaaggtccagaaccactgccaggagccctattatcaggccgcggcagcaggggcactcacctgtgcaaccccagggacctggaaagacagacaggatggggaggaggttcttcagtgtatgcctggctgtggatcatatgctgatcccatcacagaccagccctccgttaggttcagtcctcagctctgacacacaggcctgctggagaaaccctccaagcgttggtggatcttgcaccttctgtgtgcctgctgtctaactactgatgatgtggtcactgcctgatggggaactgcatcagctctgtgaattcttgcaatctattgcctgggaaagtgtcttgcacattaaacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccagg

SEQ ID NO: 2458 - DNA, 449 bp, Homo sapiens
  ENST00000545280
cagatgtccagttccagatgcctggacccagagtgtgggggaaatatctctggagaagccctcactccaaaggctgtccaggcgcaatatctcattcgtcggttcggatccaagccagttctgtggtcagcaaggctcccctctgggcaggccccctggtcagagggagttttcagcccatcagcgaggccagcaggggctctgaggccatcaacgcacctggagacaaccctgccaaggtccagaaccactgccaggagccctattatcaggccgcggcagcaggctgtggatcatatgctgatcccatcacagaccagccctccgttaggttcagtcctcagctctgacacacaggcctgctggagaaaccctccaagcgttggtggatcttgcaccttctgtgtgcctgctgtctaactactgatgatgtggtcactgcctgatgg

SEQ ID NO: 2459 - DNA, 3394 bp, Homo sapiens
  ENST00000266542
atttccaggaacttcctcctcccccaccggccttcaccttttgttccctatcctgggccagttctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctgtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccatctaccccaaggacagtgtttctctcaggaagaaccagagtgtgaatgtgttcttgggccacacagccatagatgagatgctgaaactggggaaccaccctgtccaccgtgtcgttgtgcaccccgactaccgtcagaatgagtcccataactttagcggggacatcgccctcctggagctgcagcacagcatccccctgggccccaacgtcctcccggtctgtctgcccgataatgagaccctctaccgcagcggcttgttgggctacgtcagtgggtttggcatggagatgggctggctaactactgagctgaagtactcgaggctgcctgtagctcccagggaggcctgcaacgcctggctccaaaagagacagagacccgaggtgttttctgacaatatgttctgtgttggggatgagacgcaaaggcacagtgtctgccagggggacagtggcagcgtctatgtggtatgggacaatcatgcccatcactgggtggccacgggcattgtgtcctggggcatagggtgtggcgaagggtatgacttctacaccaaggtgctcagctatgtggactggatcaagggagtgatgaatggcaagaattgaccctgggggcttgaacagggactgaccagcacagtggaggccccaggcaacagagggcctggagtgaggactgaacactggggtaggggttgggggtggggggttgggggaggcagggaaatcctattcacatcactgttgcaccaagccactgcaagagaaacccccacccggcaagcccgccccatcccagacaggaagcagagtcccacagaccgctcctcctcaccctctacctccctgtgctcatgcactaggccccgggaagcctgtacatctcaacaactttcgccttgaatgtccttagaaccgccttcccctacttcatctgttgacacagcttttatactcacctgtggaagagtcagctactcacccgctattagagtatggaggaaggggttttcattgcattgcatttctgaaacattcctaagaccctttagttgaccttcaaatattcaagctattctgcagctccaagatgcaattatagaaacagctccttttttattttatgtcctctatatgccaggtgcttcacctgttatttcacttaatcctcataccatatttgcaaaggatgtgttattatctatgtgtgacaaatgaggaaactgaggctcaggggataaagggacttgcccaagtcccacagctggtgtgtgactgcagagactgtgctcttcccagtgtgctgcaatacttctcaaccctcctctaacctgctgtgtcacccgctttccctcccagcccccacatccttaccattttccctccctgggaattcctgcttctgcgaaaatggtatcctctagctcacactttcctaatggccccatctcctgcagaagccaggtgagcccagcactggactgaagttcttgcagacaccccacctgtgcccctatcatcaggggaactgctccacctgagaggaccaactctttaatttttagtaaaacctggaggtgatgggccgggcgcagtggctcacgcctgtaatcccaacaccttaggagtccgaggtgggtggatcacgaggtcaggagatccagcccatcctggccaacatggtgaaaccccatctctactaaaaatacaaaaattagccgggcgtggtgacacgtgcctgtagtcccagctactcgggaggctgaggcaggagaatcacttgaacctgggaggcggaggttgcagtgagctaagatcacgccactgcactccagcctgcggacagaccaagacttcatcccccccaaaaaaaaaagattggaggtgatttacagtgaaagacacaaataaaatacaactgttcaatggaaatagaaaataaacaccataaaagagagaagagaggtaatttgttagcatcaagagtcaagttgctatatggtcaaaggttaaatttatctctaaaaaatggcaggattcaaagttgtacatacatgtgattacttctgttttttacacccacatacagtacaaaagattattaaaaatattcccaaaaggcaggtgcaatgatgcacacttatacccccagccactcaggaggctgatgcaagaggatcgcttgagcccaggagttgaagtccagcctaagcaacatagtgaaaccccatcgccaaaaatataataataattctctcaaaatactaaacagaggtggttttattgataagattttggctgtttggttttccactattctctattggctaaaatttgtttaatgagcatgaaatgtttttattttattttgcttatttttatgattgcaaaaaatgatatgagtttctccctgccaaggcaaaaaaatatatatatacctata

SEQ ID NO: 2460 - DNA, 504 bp, Homo sapiens
  ENST00000504702
gcgtcccctaccacagcacttcagagaagcaggagaatcacttgaacctgggaggcggaggttgcagtgagctaagatcacgccactgcactccagcctgcggacagaccaagacttcatcccccccaaaaaaaaaagattggaggtgatttacagtgaaagacacaaataaaatacaactgttcaatggaaatagaaaataaacaccataaaagagagaagagaggtaatttgttagcatcaagagtcaagttgctatatggtcaaaggttaaatttatctctaaaaaatggcaggattcaaagttgtacatacatgtgattacttctgttttttacacccacatacagtacaaaagattattaaaaatattcccaaaaggcaggtgcaatgatgcacacttatacccccagccactcaggaggctgatgcaagaggatcgcttgagcccaggagttgaagtccagcctaagcaacatagtgaaaccccatcgccaaaaatat

SEQ ID NO: 2461 - DNA, 1569 bp, Homo sapiens
  ENST00000544702
accttttgttccctatcctgggccagttctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcagcttcaactccgagcctatttctttgcctctcctcatttacgccacaggggcactcacctgtgcaaccccagggacctggaaagacagacaggatggggaggaggttcttcagtgtatgcctgtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccatctaccccaaggacagtgtttctctcaggaagaaccagagtgtgaatgtgttcttgggccacacagccatagatgagatgctgaaactggggaaccaccctgtccaccgtgtcgttgtgcaccccgactaccgtcagaatgagtcccataactttagcggggacatcgccctcctggagctgcagcacagcatccccctgggccccaacgtcctcccggtctgtctgcccgataatgagaccctctaccgcagcggcttgttgggctacgtcagtgggtttggcatggagatgggctggctaactactgagctgaagtactcgaggctgcctgtagctcccagggaggcctgcaacgcctggctccaaaagagacagagacccgaggtgttttctgacaatatgttctgtgttggggatgagacgcaaaggcacagtgtctgccagggggacagtggcagcgtctatgtggtatgggacaatcatgcccatcactgggtggccacgggcattgtgtcctggggcatagggtgtggcgaagggtatgacttctacaccaaggtgctcagctatgtggactggatcaagggagtgatgaatggcaagaattga

SEQ ID NO: 2462 - DNA, 582 bp, Homo sapiens
  ENST00000534950
ctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccatctaccccaaggacagtgtttctctcaggaagaaccagagtgtgaatgtgttcttgggccacacagccatagatgagatgctgaaactggggaaccaccctgtccaccgtgtcgttgtgcaccccgactaccgtcagaatgagtcccataactttagcggggacatcgccctcctggagctgcagcacagcatccccctgggccccaacgtcctcccggtctgtctgcccga

SEQ ID NO: 2463 - DNA, 592 bp, Homo sapiens
  ENST00000543933
cagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtgggggcactcacctgtgcaaccccagggacctggaaagacagacaggatggggaggaggttcttcagtgtatgcctgtctgcggacg

SEQ ID NO: 2464 - DNA, 561 bp, Homo sapiens
  ENST00000537833
tccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctggaaccaccaaactgtcttcaacagcagcagcaccaagttacatctcaccggcaatacatgagggttcaagcccaccatttttgagatccacgcttttgaatgaaagcattgccttct

SEQ ID NO: 2465 - DNA, 532 bp, Homo sapiens
  ENST00000534969
ggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctgcagcagcaccaagttacatctcaccggcaatacatgagggttcaagcccaccatttttgagatccacgcttttgaatgaaagcattgccttc

SEQ ID NO: 2466 - DNA, 813 bp, Homo sapiens
  ENST00000545337
ctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtgggtgagtgtccctcctgggggtgcagggagggagcctctgttcccagccatgaccctggtatcttcaagccttaagtggaagcttgagtgacagctgaggctggggactcagggacacctgggctggatcccagccctgcccctgctggcaagcaaccctattaagagacagccgtagctgagcccccagcggttgtttccatgcagatttacaggcccagtgtttgcagatcatctcatttttaaagagatgccaaaaatccagatttttaagtaaaattataaattttcaaa

SEQ ID NO: 2467 - DNA, 539 bp, Homo sapiens
  ENST00000543941
acagcttctagccctgcctcgcgaggcctctgagtcctagcgcggctcccccgctcctcccacacccacaggcttccggccatagctgcgcggccccaccttgccctccccccaactcacaggtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgt

SEQ ID NO: 2468 - DNA, 354 bp, Homo sapiens
  ENST00000539927
aaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacagtgagctggggatggggggggtcccgccaggactgtggccagggagattcccggggttgtgggaagtggcggtgccctgaatcccccatctggaggagggatgaat

SEQ ID NO: 2469 - DNA, 1335 bp, Homo sapiens
  ENST00000624391
cctcccatgttaacactattgtttctttctgtttactttcagttggttggcagagaatttgaactggagatgaactttattatccaggatgctgagagtataacatgcatgacagagcttttagagcactgtgatgtaacatgtcaagcagaaatagggagcatgtttacagccattctatgaaaaagtgttcggaatgtacagactagcacagaagctggactaattgaacaagtattgctgaaaatgagtgctgtagatgacatgatagcagagtaccttcaagtttaaatctgagagtgatattcatttggcagaacatcataaacaggttttgtatgatgggaaacttgcaagtagcattacctttacatatactgctaaggccactgatgctcaactctgcctggaatcatcaccaaaagagaatgcatcaatttttgtgcattcccaacatgctctaatgcttcagattcaagtgctttttccactgtttccccaattggataatcggcagctcaatgacagtcaagtggaaacaactgtctgctcctgcttcaggtgcagaaatacagcgatttccagtgccagctgttgagccagtgccagcaccaggggcagattcccctccagggacagcgctggagctagaggaagctccagagccctcctgccgctgccctgggactgcccaggaccagcccagtgaggagctgcctgacttcatggcacctcctgtagagccaccggcctcagccctggagctgaaagtgtggctggagctagaggtggcagagaggggtggccagcacagctccagccagcagctcccacactgctcccagtcctgggcacagtggaagctatggaggcagagaccagggtttgcaatctgggctcctctgcctcactggagagggacttctctcattcagcagagcagcagccctgctgctgaagggcctgctgctactgctgctggggctgtttgcctgcctgcaggaggtgctggagagcaagaaaaggagcctgtgagcaggggttccagcaggtcctcctgctcccagaggcgacctcctcctccaggcatggaggtttgccctcagctgggcatctgggccatttgcccctaacgtgctgcccaggatggcctcctcttgacaggcggacagggggtgagggggccagggggcatctccaaaggaagcttttaaactcagcagctgcaccccagaatctgtatgcctgcacctgcccaaggatttattcatagcttacctaagaatttcaaatttctaccataacactgaataaagtttgactttttgaaacttc

SEQ ID NO: 2470 - DNA, 969 bp, Homo sapiens
  ENST00000623058
ttggttggcagagaatttgaactggagatgaactttattatccaggatgctgagagtataacatgcatgacagagcttttagagcactgtgatgtaacatgtcaagcagaaatagggagcatgtttacagccattctatgaaaaagtgttcggaatgtacagactagcacagaagctggactaattgaacaagtattgctgaaaatgagtgctgtagatgacatgatagcagttgtctttacagttttcatgctagcaaaggagttggttactctgctcattttgttggcaactgttttatagtcacatcattgaagtccaaaggaaaatgttttcagcattgtgtgaaatatgattttcaaccacgtaagtggtacatgatcagcattgtccacatttacaatcgatggagaaacagtgaaattcagtgttatgttaatggacaactggtatcttatggtgatatggcttggcatgttaacacaaatgacagctatgacaagtgctttcttggatcatcagaaactgctgatgcaaatagggtattctgtggtcaacttggtgccgtgtatgtgttcagtgaagcactcaacccagcacagatatttgcaattcatcagttaggacctagatataagagtaccttcaagtttaaatctgagagtgatattcatttggcagaacatcataaacaggttttgtatgatgggaaacttgcaagtagcattacctttacatatactgctaaggccactgatgctcaactctgcctggaatcatcaccaaaagagaatgcatcaatttttgtgcattcccaacatgctctaatgcttcaggatgtgaaagggatagtaacacattcaattcatagtgcaattcattcaattggacagattcaagtgctttttccactgtttccccaattggataatcggcagctcaatgacagtcaagtggaaacaactgtct

SEQ ID NO: 2471 - DNA, 656 bp, Homo sapiens
  ENST00000463645
gccacttctaccatctgtgaaatgagggatgggagggggaacttgaggaagtggtattagatgatcattaatagtcctgtcagcatattattgtagggttttatgaatattataattgcattttagaccataataaccaaacattacatattgatatatttaatttttttatttaagtggtacatgatcagcattgtccacatttacaatcgatggagaaacagtgaaattcagtgttatgttaatggacaactggtatcttatggtgatatggcttggcatgttaacacaaatgacagtaccttcaagtttaaatctgagagtgatattcatttggcagaacatcataaacaggttttgtatgatgggaaacttgcaagtagcattacctttacatatactgctaaggccactgatgctcaactctgcctggaatcatcaccaaaagagaatgcatcaatttttgtgcattcccaacatgctctaatgcttcagattcaagtgctttttccactgtttccccaattggataatcggcagctcaatgacagtcaagtggaaacaactgtctggtaagttttctttacatgtgcaattgctggtattttatacacacttagactatgcatgatgtactcagtgctgtgtaaatgtat

SEQ ID NO: 2472 - DNA, 266 bp, Homo sapiens
  ENST00000466372
tgctttcttggatcatcagaaactgctgatgcaaatagggtattctgtggtcaacttggtgccgtgtatgtgttcagtgaagcactcaacccagcacagatatttgcaattcatcagttaggacctagatataagagtaccttcaagtttaaatctgagagtgatattcatttggcagaacatcataaacaggttttgtatgatgggaaacttgcaagtagcattacctttacatatactgctaaggccactgatgctcaactctg

SEQ ID NO: 2473 - DNA, 996 bp, Homo sapiens
  ENST00000481510
cttggtgccaaactgttgcctgctgttcacctggggtatgctgtccacctggggcatattgtccacctggggtctggatgtcagcctggggcttgttgtacacctgtatcttagatatctagataggggtctgttttctgcttaggtgcagcagtccacctggtgcttgagtgtcaacctacggcctgatgtctatgttggacctagggttcacctgaggcctgatatccacctggggcctcaatgtccaaatggagcctgatgcccatctgggccctgggtgtctacctgtggcatggatgtccactggtactttatgtccaccaggggcctaatgtccacctaagacgtggtgttcacctggggtctgatgttcagctgaagactggatgtccacctggagctgaggaatccacccagggactggtgttgaactggggcctgatgaccaccgggggacaaggtatccacaccaggcttgatgtccacctgtcaccagatgtctacctcctgcttcaggtgcagaaatacagcgatttccagtgccagctgttgagccagtgccagcaccaggggcagattcccctccagggacagcgctggagctagaggaagctccagagccctcctgccgctgccctgggactgcccaggaccagcccagtgaggagctgcctgacttcatggcacctcctgtagagccaccggcctcagccctggagctgaaagtgtggctggagctagaggtggcagagaggggtggccagcacagctccagccagcagctcccacactgctcccagtcctgggcacagtggaagctatggaggcagagaccagggtttgcaatctgggctcctctgcctcactggagagggacttctctcattcagcagagcagcagccctgctgctgaagggcctgctgctactgctgctggggctgtttgcctgcctgcaggaggtgctggagagcaagaaaaggagcctgtgagca

SEQ ID NO: 2474 - DNA, 3728 bp, Homo sapiens
  ENST00000319974
cttcctttccttacgcacgctgcgcgcggacgtcggcctctgacgtcgtcgcctcagcgccggctcccggccgggccgcggccgccgaccgttgagccgccggctgagccgcctgctgaagtccctccctcaggaacccctccgccaccctccacctccgaaccgctctcgcggcggcgacccatgtgggggttcaggctcctgcggtcgccgccgttgctgctcctgctgccgcagctcggaatcggaaacgcctcgtcctgctctcaggccagaaccatgaacccgggcggcagcggcggcgcgcgatgctccctctcggccgaggtgcgccgccgtcagtgcctgcagctttccaccgtgcctggagccgatccgcagcgcagcaacgaattgctcctgttggcggcggccggggagggactggagcggcaggacctccccggggacccagcgaaggaggagccgcagccgccgccccagcatcacgtcctctatttccctggggatgtgcagaattaccatgaaattatgactcgtcatcctgagaattatcaatgggaaaactggagtctagaaaatgttgctaccattttagcccaccggttccccaatagttatatttgggtgataaaatgttcccgaatgcatttgcacaaattcagctgctatgacaattttgtgaaaagtaacatgtttggtgccccagaacacaatactgactttggagcttttaagcacctttatatgttattagttaatgcttttaatttaagtcagaatagtttatcaaagaaaagtttgaatgtttggaataaggactccatagcatctaactgtagatccagtccttctcatactacgaatggttgccagggagaaaaagtgaggacctgtgaaaaatctgatgagtctgccatgagtttttatccaccatcactaaatgacgcatcttttactttgattggattcagtaaaggttgtgttgttttgaatcagttgctttttgaattgaaagaagccaagaaagacaagaacatagatgcttttatcaaaagcataagaacaatgtattggctggatggtggtcattctggaggaagcaatacttgggttacttatccagaagtcttgaaagaatttgcacaaacaggaattatcgttcacactcatgtaacaccttaccaagtacgtgatccaatgagatcttggattggaaaggagcacaagaaatttgttcagatacttggggatcttggtatgcaggtgactagccaaattcattttacaaaggaagctccttccatagagaatcacttcagggttcatgaagtattttgagattacaggtatattaatgaacttgttcagtggaagaacataagcacttttgagtgttataaattcagataatgggatgtaattcatagctgcattgtcagttttggggtatggggggaagcacacattcctaaaatgtgagtgtaatgtgcaatagtattttttgcttgtgaatgtgagcagttattaatttggattgagttagaattagttaatttgaaatctaacaaggtggtttgtaataatgctgaggagatataagacccttaaaatgaaagttacaacattgttcttataaaaggtaactaaaattgttactgttggaaataactgattttctgagtaatgttttaaactaatttggtgacattttaacagtaattagctattttgagtggaaatattttcatttctcttcaaacaaaagcaaaggtacgatgctgttttctatcattttggaataactgcaccctgccttttgtgtttttgtaaactccttgactcattctttcatgtgtcaccaagtacttttctcatgagagtcaacatatatttgtttccaaatgtccacaagtgtacaatagtgtaaaggtggtttttaaaaacatagccaggtgtggtggcacgtgcctttagttccagctactcaggaggctaaggcaggaggattgcttgagcccaggctgtgtggttcaccataattgtgtttgtgactagctactgcactccaacctgggcaacatagtgggacttcatctctaaaacaaaacaaaacaaaattacacttaagcactattgtttaatttttaattgtcagtttatcattattttgggtaagacattctggggtttcttgaatcttgtccaaaaaccagttgttttggaaaattgctttaaattgagcatatttatgtatattggataaaaatgtactacagagcaaatttcaaatttttcattatatcagtctttttgaaaggatcaacttggataaaataaatatataatgctctatttgttagagctctattaaaaaggaaacagattccatagatctaagtcaatgtttctccagaagcatgattttgtctgccaaaagaaaatagctctctttggccaaaatgcaaaattacattgctataagaaaagttacaagggaaagtttgaagacacaaatgatttaattttggctcaaaaactgaatttgcttaacactgctacataatttgggtgaagtttccttctgcccgtttttcttgacctagataaatacactttgagaaatccagatctaataaatgtcaaccaacattgacattgtaattgggtgattacaataaaaggtgagcagtttgttgtttattaataattagcttttgcaggtaatgaaatagcagggaagtaacatgctgctttaggactaaaaaaaaaaaaaaaaaaaagacactgaagcttaataccttaatgacccagaagacctagatttataaagccatatagaataaaaatgttaatttcttggtttcttcccagaattatattttaatgactccataaatacattccaaatattcagagattcatgagaaaggattcttaacaaatgtttaaaaataacatttctttttggtgttttaacacttaattttataaactgcagaacagcatctctaaatggctttttttttttttttaaagacaaagtagtattatgttgcttcagtttctttaaatacctcgtttcttttgagaccaaaaattcccatcaaggaaataaatcagcctgattttaacattttacatattacattgcctttaagcactatgattggatggctttttttctatttgtttaataatccttggctaaattcacatgtatctaaaggaaaatagctgagttactgaattctataaggggaagaaaaagcatttattttcacatgattaactgaaatggaaaagtaagacatttagcagaataattcatttaaaaataattttaaaaaatcagacatatttaaaaatctaggttgtctatccagtatgtgaatgcttaattataattgttacatgttgaatgggtattaagagtaagtcaccaggtacacaaaactgccatcatagcaaaatgagacagtgttgaaaagacaaaatattttctggaatgaaaatatattcaagttgatccatattcagatgttttctgtttaatacttcagattggtcctttgtccacatttgtttaaaacttattgtaatgttaatttacacttttggattgtgcctttgtcatgagttgagaaaagtagtcctacaaataatgtgaaagttgttaccaccacagcatgaatgtataattgtattaaaattgatcatccacagaa

SEQ ID NO: 2475 - DNA, 1034 bp, Homo sapiens
  ENST00000491721
gcctcagcgccggctcccggccgggccgcggccgccgaccgttgagccgccggctgagccgcctgctgaagtccctccctcaggaacccctccgccaccctccacctccgaaccgctctcgcggcggcgacccatgtgggggttcaggctcctgcggtcgccgccgttgctgctcctgctgccgcagctcggaatcggaaacgcctcgtcctgctctcaggccagaaccatgaacccgggcggcagcggcggcgcgcgatgctccctctcggccgaggtgcgccgccgtcagtgcctgcagctttccaccgtgcctggagccgatccgcagcgcagcaacgaattgctcctgttggcggcggccggggagggactggagcggcaggacctccccggggacccagcgaaggaggagccgcagccgccgccccagcatcacgtcctctatttccctggggatgtgcaggttctgccccgcgcgagggcctcacctgtgggtagaggtgctgcatgaactgctcccgagaaacgccctccagccggggtaccgggaggtgctgcccggccatggttgctcacgcctgccctcttccaggtcttcggaacttcggctctaaagcgttcctcagcgccatccgcccggaaacacgagcgacagagaaaaggtccgcgaggccggcagactccagagtggctgggtccgagcgcggggcgggttgccgaagggcctcggcctgggctgcgtgctggagagcggggacggggccgactcaccagaggctgcagcaacaggtccactttgctctccagtctctttctccgacaccgctgaggcggtttcccaccgacttcctttccatacagcaccggcaggcaccggtgtgaagggtcataaaaatggcgctggccgctcgtttgctaccccagttcctgcactctcggtcgctgccctgcggggccgtccgactccggactcctgctgtggccgaggtgaggctgccgtcggccacactttgctacttctgccgctgtcg

SEQ ID NO: 2476 - DNA, 3657 bp, Homo sapiens
  ENST00000373640
gggcgccaccgccccgagaggcgggcagcgggtgcgcccgggccgcggcggccgcagagggcgggcggcggccagcatggagcgcgagctggaggcgctggcggcccggcttgcgcgccctgccgagccgcccttccaggcgttggtggaagcggcggggggccgcgggcaggtgctgctggtgggcgagctgtgggagcgcgaacagagccgcgcgctgctgcgggacttcgcacgggcggtgttcccgccggagccaggcgcggccaagccgggcggcgcggcggcagagggcgcggggcccggggcggcgcgcggggcgcagagggcggcgagggcggctggggcggcgggggcggcggcggcggcggcgcgcgccatccgctcgccgctggtcttcgtgctgtgccgcgcgtcgtcgctggccgcccgggagccgcggcgccgcctgcgggagatgctgcgggacgtgcgcggccggcggcgggccggggcggcgctggtcggggtgctggtggccgaggccgggccagaggacgcggtggcgccggggctgcggctgctggaggcgctgttgcgcgccgtgttcggccgccaggcgggggggcccgtgcaggcggccgcctactgccccggcctcccggcctcctgcctggccgtccaggcggccgcctgcagggccctgcaagccgccggagccgggcaaccagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagagggagctttgtttaagtttggaatttgcctaaggcagaagttataaggcttcataaccttttgtatgtattgccaatatttgaaacttgggagattacgtataaaaaatacctagttttctgggtggaggatggggcatgctgtcatctcaagtctgctgcggctcacccccaccacctttaccccctcccccgcccttcccatcccccactgcacttcactcatgtaagacgtctgcccggtgctggtccaggcgggcatgtgagtttgtagcctctgctccaaaggatggtttacacattattttttcattaccttcagtattcctgtgaatggttcaagagagaaagtcttcatttactaagatttgggttctgcctcccaagtgacaatacggggctgagatccctctcagcttctttgagatgtggccaccataagcatcatcgttgtagggacagtctcattgctgtcttctagcagacagaagagttaggtgccagaaaggacaatcttgatggtgggtcccctccctgaaggactttaagaaggcataaaggggttggggtggagggtggcgtgtgaaggaggaggcccttgattaggtcagtggtccctgggagccatcggcgagaggcctccagccgggtgacagtctgggctctcgggtactaatctttctaatatggcagtggttgtggcacttctgacttgaattgataattctcatatctaataaaaccaagaagtacctcgttgatatcttatagaaaa

SEQ ID NO: 2477 - DNA, 579 bp, Homo sapiens
  ENST00000477463
cagcatggagcgcgagctggaggcgctggcggcccggcttgcgcgccctgccgagccgcccttccaggcgttggtggaagcggcggggggccgcgggcagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatc

SEQ ID NO: 2478 - DNA, 3141 bp, Homo sapiens
  ENST00000463834
aagcaatcatttttaaagttcggttttaaaaacccacccacttttgcaaatcagactctgtgtttttaatcagacagttgaaactagggcagttgaccgttggggcacttgatttgctaaacgaaatctctcagtcttgtgaagtgggaaccatgtgaccctctgactcaggttttgtgttcttcctagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagagggagctttgtttaagtttggaatttgcctaaggcagaagttataaggcttcataaccttttgtatgtattgccaatatttgaaacttgggagattacgtataaaaaatacctagttttctgggtggaggatggggcatgctgtcatctcaagtctgctgcggctcacccccaccacctttaccccctcccccgcccttcccatcccccactgcacttcactcatgtaagacgtctgcccggtgctggtccaggcgggcatgtgagtttgtagcctctgctccaaaggatggtttacacattattttttcattaccttcagtattcctgtgaatggttcaagagagaaagtcttcatttactaagatttgggttctgcctcccaagtgacaatacggggctgagatccctctcagcttctttgagatgtggccaccataagcatcatcgttgtagggacagtctcattgctgtcttctagcagacagaagagttaggtgccagaaaggacaatcttgatggtgggtcccctccctgaaggactttaagaaggcataaaggggttggggtggagggtggcgtgtgaaggaggaggcccttgattaggtcagtggtccctgggagccatcggcgagaggcctccagccgggtgacagtctgggctctcgggtactaatctttctaatatggcagtggttgtggcacttctgacttgaattgataattctcatatctaataaaaccaagaagtacctcgttgatatcttatagaaaacaaaa

SEQ ID NO: 2479 - DNA, 3657 bp, Homo sapiens; identical to SEQ ID NO: 2476
  ENST00000373640

SEQ ID NO: 2480 - DNA, 579 bp, Homo sapiens; identical to SEQ ID NO: 2477
  ENST00000477463

SEQ ID NO: 2481 - DNA, 3141 bp, Homo sapiens; identical to SEQ ID NO: 2478
  ENST00000463834

SEQ ID NO: 2482 - DNA, 802 bp, Homo sapiens
  ENST00000486488
ggacttttctttttccgttatccagggaaatgcgtgagttactatgacagatgccaaagacttttggctctggtagtggaaattgggaggcaatggtgaaatgaagtaagaaattccagggccagaaggtggatgcaagtcagcaacggcttttcccaggagcttgctctttttggacagcataaaatagaggatgctgctataacatatgtaagtgaaaatgaagaaattaaacacgaagaaaaacctggaaaaagcatacatcattcaaaatcacatgttggaagaggacgtatatattatgctaaattcattaacacaaatgcaagaacatacaatgaaccatttccctacatagatcccaaaaaagggccagaaatacagggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagtaccacttgcctctcctggtacatcagcagaacttcaaaacaattttatagaatacatctcttttatacatcaatatgatgccagaaaaactccgaatgagcctctccagggaaagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaa

SEQ ID NO: 2483 - DNA, 576 bp, Homo sapiens
  ENST00000405749
gcacccttttcctggcagggctgcgtccctgttcttcccaggaggctcctcgctgcctggtgccgtagaggcccatggaggaaaaggaagataagcatcaacagcataaaatagaggatgctgctataacatatggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagatgaaaccttgagaaaaggagccaagactgtaacagtggtcctgtgccacagtgcaggaagaaaaggaacagagagatcacgggcatgtttttttaggtggtttcatgccatcttattttctccttgaaatacattcacaatgaggtgactggctctgtgggaagcctatggccatgttgtaatgacactcaatcagcccagtggagagggccacatggcaaggaactaaggcctcccaccaacagccagcaaagaactgagaccttctgcctacagtcatgagtcct

SEQ ID NO: 2484 - DNA, 1921 bp, Homo sapiens
  ENST00000398634
tcttcccaggaggctcctcgctgcctggtgccgtagaggcccatggaggaaaaggaagataagcatcaacagcataaaatagaggatgctgctataacatatgtaagtgaaaatgaagaaattaaacacgaagaaaaacctggaaaaagcatacatcattcaaaatcacatgttggaagaggacgtatatattatgctaaattcattaacacaaatgcaagaacatacaatgaaccatttccctacatagatcccaaaaaagggccagaaatacagggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagtaccacttgcctctcctggtacatcagcagaacttcaaaacaattttatagaatacatctcttttatacatcaatatgatgccagaaaaactccgaatgagcctctccagggaaagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcctgagagcagagaaaagacctcaggcgccactcaaacaactgtaggagatgctcttttcactaggcacaagcctttaaatccaccaattaaaaaatcagaataaattaccttcttcagataaaaatctaatccctggaatatagggaaatttcacaatcatcatcttggccctcacatttacttttctgttatcagtaacttcagaacatacaatttatgtaaatggaaaaagagaaaaaagacaattaaaatacaaccaaatgttattaataagagtggtctccaataagtggagtgagacattatttctatgtcacattctttatgaacacaactttgttttgcacaacacatgatcgtaattaacaaatataatacttttagaagagaggccctgttagacatgagtggacagctttggaatcaaacaaactagagttggaatgttggcttcacttcattccttgagctgtgtgaccttgggtaagtaacttaacctctctagacttcagttttctcaactgtaaaattaggaaaatagcaacttcgtaagattattgaggatgtgattatgcacattgatcagtaagtggtcaatgtaatcatatcatcactgctactataattcaattttcaatttaaggataatgttctcttatatatttaatttttcctcattattctaaaacttagaactcctccatatataattaaaagtgtgaaaatctaaaaatacttctgccagtacaagatgcacagacacatacacacttaattcaaagacatatgggtacttagaatattgaagtattttctaaattgttttctattttactcagatcatttctagcaccaactcaacctttgctttttggatgagtttggtaaggattaattctacttccaatttggtgtgtttggtgtgccaaaatgtatctattataagatatgttatattgcatacaagtggaagtaggtggagtattcctctgttataaagagtatttacaaatttccattgggaaatatcagctgctcactattatctgcagtattgataagactacagctatatctttatccatttattctccattaaagaaattgtgataaactgc

SEQ ID NO: 2485 - DNA, 1713 bp, Homo sapiens
  ENST00000317627
tcttcccaggaggctcctcgctgcctggtgccgtagaggcccatggaggaaaaggaagataagcatcaggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagtaccacttgcctctcctggtacatcagcagaacttcaaaacaattttatagaatacatctcttttatacatcaatatgatgccagaaaaactccgaatgagcctctccagggaaagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcctgagagcagagaaaagacctcaggcgccactcaaacaactgtaggagatgctcttttcactaggcacaagcctttaaatccaccaattaaaaaatcagaataaattaccttcttcagataaaaatctaatccctggaatatagggaaatttcacaatcatcatcttggccctcacatttacttttctgttatcagtaacttcagaacatacaatttatgtaaatggaaaaagagaaaaaagacaattaaaatacaaccaaatgttattaataagagtggtctccaataagtggagtgagacattatttctatgtcacattctttatgaacacaactttgttttgcacaacacatgatcgtaattaacaaatataatacttttagaagagaggccctgttagacatgagtggacagctttggaatcaaacaaactagagttggaatgttggcttcacttcattccttgagctgtgtgaccttgggtaagtaacttaacctctctagacttcagttttctcaactgtaaaattaggaaaatagcaacttcgtaagattattgaggatgtgattatgcacattgatcagtaagtggtcaatgtaatcatatcatcactgctactataattcaattttcaatttaaggataatgttctcttatatatttaatttttcctcattattctaaaacttagaactcctccatatataattaaaagtgtgaaaatctaaaaatacttctgccagtacaagatgcacagacacatacacacttaattcaaagacatatgggtacttagaatattgaagtattttctaaattgttttctattttactcagatcatttctagcaccaactcaacctttgctttttggatgagtttggtaaggattaattctacttccaatttggtgtgtttggtgtgccaaaatgtatctattataagatatgttatattgcatacaagtggaagtaggtggagtattcctctgttataaagagtatttacaaatttccattgggaaatatcagctgctcactattatctgcagtattgataagactacagctatatctttatccatttattctccattaaagaaattgtgataaactgc

SEQ ID NO: 2486 - DNA, 656 bp, Homo sapiens
  ENST00000447328
tgcctggtgccgtagaggcccatggaggaaaaggaagataagcatcaacagcataaaatagaggatgctgctataacatatggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagtaccacttgcctctcctggtacatcagcagaacttcaaaacaattttatagaatacatctcttttatacatcaatatgatgccagaaaaactccgaatgagcctctccagggaaagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcctgagagcagagaaaagacctcaggcgccactcaaacaactgtaggaga

SEQ ID NO: 2487 - DNA, 560 bp, Homo sapiens
  ENST00000414747
ggaagataagcatcaacagcataaaatagaggatgctgctataacatatggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagagacacggagcttttgtacagagagagataaaaccaggcagtaggccaacagttcctaaaggagcagagatgaaaccttgagaaaaggagccaagactgtaacagtggtcctgtgccacagtgcaggaagaaaaggaacagagagatcacgggcatgtttttttaggtggtttcatgccatcttattttctccttgaaatacattcacaatgaggtgactggctctgtgggaagcctatggccatgttgtaatgacactcaatcagcccagtggagagggccacatggcaaggaactaaggcctcccaccaacagccagcaaagaactgagaccttctgcctacagtcatgagtcct

SEQ ID NO: 2488 - DNA, 622 bp, Homo sapiens
  ENST00000491538
ggaagataagcatcaagacacggagcttttgtacagagagagataaaaccaggcagtaggccaacagttcctaaaggagcagagaagagaggccctgttagacatgagtggacagctttggaatcaaacaaactagagttggaatgttggcttcacttcattccttgagctgtgtgaccttggatgaaaccttgagaaaaggagccaagactgtaacagtggtcctgtgccacagtgcaggaagaaaaggaacagagagatcacgggcatgtttttttaggtggtttcatgccatcttattttctccttgaaatacattcacattttgtgttgaagtgaatgaagctctagaaagccaaaggacagaaggagccaggacctctgagtcatttggaggagtgctaccctagaaagccacccctatcatgttaaaccacaaatttgggacttgtttgctatagtagatagtgctaattctatgtaatatactctcgtttttacttctcatagcatttattgttctctaccataaataattattcgcgtaaatatattttttcattttagtctattagttgctttaaaaaaaaaaaaactacattgccatggtttgactgtgtcc

SEQ ID NO: 2489 - DNA, 1376 bp, Homo sapiens
  ENST00000615983
cgtagaggcccatggaggaaaaggaagataagcatcaggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcctgagagcagagaaaagacctcaggcgccactcaaacaactgtaggagatgctcttttcactaggcacaagcctttaaatccaccaattaaaaaatcagaataaattaccttcttcagataaaaatctaatccctggaatatagggaaatttcacaatcatcatcttggccctcacatttacttttctgttatcagtaacttcagaacatacaatttatgtaaatggaaaaagagaaaaaagacaattaaaatacaaccaaatgttattaataagagtggtctccaataagtggagtgagacattatttctatgtcacattctttatgaacacaactttgttttgcacaacacatgatcgtaattaacaaatataatacttttagaagagaggccctgttagacatgagtggacagctttggaatcaaacaaactagagttggaatgttggcttcacttcattccttgagctgtgtgaccttgggtaagtaacttaacctctctagacttcagttttctcaactgtaaaattaggaaaatagcaacttcgtaagattattgaggatgtgattatgcacattgatcagtaagtggtcaatgtaatcatatcatcactgctactataattcaattttcaatttaaggataatgttctcttatatatttaatttttcctcattattctaaaacttagaactcctccatatataattaaaagtgtgaaaatctaaaaatacttctgccagtacaagatgcacagacacatacacacttaattcaaagacatatgggtacttagaatattgaagtattttctaaattgttttctattttactcagatcatttctagcaccaactcaacctttgctttttggatgagtttggtaaggattaattctacttccaatttggtgtgtttggtgtgcca

SEQ ID NO: 2490 - DNA, 5263 bp, Homo sapiens
  ENST00000245907
agataaaaagccagctccagcaggcgctgctcactcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtgagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgctgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattcccccactccagataaagcttcagttatatctcacgtgtctggagttctttgccaagagggagaggctgaaatccccagccgcctcacctgcagctcagctccatcctacttgaaacctcacctgttcccaccgcattttctcctggcgttcgcctgctagtgtg

SEQ ID NO: 2491 - DNA, 368 bp, Homo sapiens
  ENST00000601475
tcctccccacgactcagcttcttccctctcccctccactccaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 2492 - DNA, 1992 bp, Homo sapiens
  ENST00000599899
attgagatgcaaggtgtatttgttgttttttttttcctttgtatgacacttacggagagtactttagttcaaaaaaatgcttgccttcttctctttgtataatttacaacatggagtaaacatcttttctatgccttagtaccttgtcttgctcctttctaagtttggatcagcttccaatattttatcctttgagctttccatgacacaaaattcctccaagagttcctttaaagtgactttgtattctataatgtcccttcctctgggacatcttcatcctttttgtccccatgaccttccttatttatgctaatacatttgccttccctgagttcctctacactacctatctctcaaatggcagcagggtcaacatcaccatagtctgctattctttgataactccatttatgctgtctttgaagttcacttctggcattatcacttttcatttctttgctgcatttttatctttgttggccagttccctcttttcgtgatacattgttgtaaaatctcatgggagttagccacctggagacagggaggcaacagaactacacactttgctgtctgtgcataaattgaagagcagaagctcagtgaccaatcactgatggactttgaaaggagtgacagtaattggccctcaattatgatgcttatcttttatttatgtcgtgatttctagactgaagagttagcaacaaagtttataccatatgcaactactcgtgatcaatataccaaggtactgaaaaagaaccatgtcactgggctactagtgttatttaactgaatcatgcagagtgagggctgcctgtattcttgccttgttttctagaactgaagcatggagggtcaaataatgcatccaatgttatttagagctggaatttgaatccatgcagttgggtgcagagtctgagctcttaatcaccttgaccattacattaccttgctttttatttcctttggggaaatgtttcctaaaaaatgtaacgcccctctgtgctgctatgtgggaatcagaagtctcagtgcctgatcagacctccttgtccaggaacagacccttggggctgacccctccttgggacccaatgcccttctttctgcactatccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattcccccactccagataaagcttcagttat

SEQ ID NO: 2493 - DNA, 585 bp, Homo sapiens
  ENST00000602229
cttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaagtgagtgctttccctgcgcgtgcgcgcgaccgcccgactgccccgcccatgccacgcccacaccattgtcacgcccctgcgccacgcccacaccacgccccttcctgacctgccattcttccctccagcctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattccccc

SEQ ID NO: 2494 - DNA, 627 bp, Homo sapiens
  ENST00000599668
agccaacctagggcctggggtctgatggttccaggggcctgagagtcccagaggaaagctgtacccggttctaccatccggaaaaggaggatggaaagctgaacaagctctgccgtgatgaactgtgccgctgtgctgagggtgagttccctggagccgggaacagagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattcc

SEQ ID NO: 2495 - DNA, 303 bp, Homo sapiens
  ENST00000601008
aacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagacgaagagaaccagaaacaatgccaggacctcggcgccttcaccgagagcatggttgtcttt

SEQ ID NO: 2496 - DNA, 576 bp, Homo sapiens
  ENST00000596548
atcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacaggtataccctctcccatctttctctcttctgtgtttctagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctg

SEQ ID NO: 2497 - DNA, 280 bp, Homo sapiens
  ENST00000596179
gctaaggccaaagatcaactcacctgtaataaattcgacctcaaggtcaccataaaaccagcaccggaaacagaaaagaggcctcaggatgccaagaacactatgatccttgagatctgtaccaggtaagaagctaggtcaccggggttcatcttggccatccctctatctctagcaagaattcttgcaaataatatccatgatattcagtactttccaagtacactgtgtatctgatactgttctaagtatccaccatgaggtagacaacacagacagt

SEQ ID NO: 2498 - DNA, 563 bp, Homo sapiens
  ENST00000596238
ctagcatgcatctctttctgagctttctctgagccatccccaggctggacagagcagtgagcactggggatggggtatcttctttgcagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacag

SEQ ID NO: 2499 - DNA, 873 bp, Homo sapiens
  ENST00000598805
gctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaaggtgagggttggcctggaggggtgaagggagatgcatggctgaagttcagggcgggagatactgagctgggatgcatggcttttagctgagctgggacagatgaccctaagccaagctgagatggatagtcctaaggtatcaagctgggatgcataaccctgagctgagctgggatgcacggctctaagttttcgcaggtcctcattgtaaaccacacgagaaagtttgttgcgtcatttattcaacaaatgcgtattaagcattcatttcaaagggagaagtgagagttgatgaaacaagagaggtaaggcaggagccaagtaattgagagcctcgaatgtcagccaggacacccaaacaccaggaagtctagcatgcatctctttctgagctttctctgagccatccccaggctggacagagcagtgagcactggggatggggtatcttctttgca

SEQ ID NO: 2500 - DNA, 418 bp, Homo sapiens
  ENST00000594005
tcgaaacgagcaggtggaaatccgagccgttctctacaattaccggcagaaccaagagctcaaggtgggtcccggggtggcagaggcttcttggaggctgccagggggtaggtagcctgttgcacacacacttgcccggatcctttctctccctggcaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgctgtctaccatcatttcatcagtgacggtgtcaggaagtccctgaaggtcgtgccggaaggaatcagaatgaacaaaactgtggctgttcgcaccctgg

SEQ ID NO: 2501 - DNA, 621 bp, Homo sapiens
  ENST00000602053
tagtagagatggggtttcaccatgttgtccaggctggtctcaaagtcctgacctcaagcgatccacccacctcagcctcccaaagtgctgggattacaggggtgagccaccgtgcccagccttaatttttgtatttttagtagagatgggtttcaccatgttagctaggctggtctccaactcctggcctcaagtgatccacctgccttggcctccctaagtgctgggatttcaggcatgagccatggcaactggcctgctctgttctaaatgcagatctaaaccccctgcaggtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtgagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaacca

SEQ ID NO: 2502 - DNA, 406 bp, Homo sapiens
  ENST00000600763
cgcctcctccttgtttcttccgcacccctgggactccttcccccatcccggatccctccctgcgttccctgccactcaccctccccagcctgatgccagcctgtccccccagatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcc

SEQ ID NO: 2503 - DNA, 349 bp, Homo sapiens
  ENST00000594270
attgaggatggctcgggggaggttgtgctgagccggaaggtactgctggacggggtgcagaacccccgagcagaagacctggtggggaagtctttgtacgtgtctgccaccgtcatcttgcactcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacacccca

SEQ ID NO: 2504 - DNA, 469 bp, Homo sapiens
  ENST00000597442
ggggggctggggggtggagtcaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtgg

SEQ ID NO: 2505 - DNA, 714 bp, Homo sapiens
  ENST00000595577
gtatgtcaggttcttgaggagggggctcagggctcccctatccccggagagggagcaggggggctccgaggcctgagagaccactcatccgccctcctcacagcatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggag

SEQ ID NO: 2506 - DNA, 625 bp, Homo sapiens
  ENST00000594936
actcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgaggtgccagccagagggggccccaggggaagcaggggcacaggcttaggagaggcaaagaga

SEQ ID NO: 2507 - DNA, 708 bp, Homo sapiens
  ENST00000600744
agggcctgcgctgctgtgggagcgagggtctctctctgtcacccaggctggagtgcagtggtgcaatctcagctcactgcaacctctgcctcccggcttcaagcgattctcctgcctcagcctcctgagtagctgggattacaggcacccaccaccacgcctggctaatttttgtactttcagtaaagacggggtttcaccatgttggccaggctggtctccaactcctggcctcaagtgatctgcctgcctcggcctcccaaagtgctgggattacagacgtgagccactgcgcctggcaaggggatgcagtttcaaaagctgaaccccaattctggagagcaagcaggtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacag

SEQ ID NO: 2508 - DNA, 895 bp, Homo sapiens
  ENST00000358105
ctgccctcctgcttccgttgctagggacgcttcggccgaggataccgcaatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagttccgtgatctttattcgtgacagaaattctcatgggcaagagatatcaggatacatcgactatgcccacaggctaaagacggaagattttgaagtctactttactggaaaaaaaagacttcttccaaggcctacagatataagcttttacaactgggacgctgatattgctgttagtaattcaagtcccaactatcaagtgattgccgataatccagaaggcttacttttcagatacaaaagagacagaaaaattcttaatgtggacccaaaggcgcagccaggtgacaactctactagaatcactatcctgacagaactctacgtacaagctgtcatttttgaccacatttccagaaggaagacttaagtaccaacatgttaatttcctaataatttgctaaatttaaataaattccgtagacagagcaaattagaataataaatgagccctgtagctggaaggcaaattagaacaataaagttaataaagaagttagaaagaaaactgtaa

SEQ ID NO: 2509 - DNA, 729 bp, Homo sapiens
  ENST00000512931
agggacgcttcggccgaggataccgcaatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagtgctggagtgcaatggcaccatctcggctcactgcaacctctgcctcctgggttcaaggaattttcctgcttcagcctcccgagtagctgggattacaggcatgcaccaccacacccggggtatacaaaaatggttaaaactctgtccaagctttcaagaaacaacagtggacaacatcaaattgacaccaaggagatagatggatggtgagtttacttctcactaagaagataagggagacttcacctagaaagtgcggtttaaactgcaacttaaaataagcagttttctggtatacagctagagggaaaggtcatttcagagggaggaaactggactaacaaagggcgataggaggagagcagaaag

SEQ ID NO: 2510 - DNA, 777 bp, Homo sapiens
  ENST00000514249
agggacgcttcggccgaggataccgcaatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagtgtcagactctcagttaatctttcctagatctggacaaagaaaagcctcaaagaaaacctgtttccatcaatgctgattctctacagatgcaaatctctcccacaaaaggacgctaacaagtgctggtaaagacctacaagataattttctgacggccctggcaatgagagaagaagacaatcgcagtggaaaactgagtggtatacaaaaatggttaaaactctgtccaagctttcaagaaacaacagtggacaacatcaaattgacaccaaggagatagatggatggtgagtttacttctcactaagaagataagggagacttcacctagaaagtgcggtttaaactgcaacttaaaataagcagttttctggtatacagctagagggaaaggtcatttcagagggaggaaactggactaacaaagggcgataggaggagagcagaaagtattacagagggaagaaactatgggtcaggaggagaagggagctacctgaagtcca

SEQ ID NO: 2511 - DNA, 492 bp, Homo sapiens
  ENST00000502497
gggacgcttcggccgaggataccgcaatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagtatactggaacccatcttgaatcatgctatggaccgaaagtctgtgacctccccacctaaattcatacgttgaaatcttcactccctaagtgatagtattaggaggtgagggcctttgaaggacaattacatca

SEQ ID NO: 2512 - DNA, 3349 bp, Homo sapiens
  ENST00000513920
aatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagtgctggagtgcaatggcaccatctcggctcactgcaacctctgcctcctgggttcaaggaattttcctgcttcagcctcccgagtagctgggattacaggcatgcaccaccacacccggtccgtgatctttattcgtgacagaaattctcatgggcaagagatatcaggatacatcgactatgcccacaggctaaagacggaagattttgaagtctactttactggaaaaaaaagacttcttccaaggcctacagatataagcctgagaaaaaggattcttcagagacaagataagtaaattcccagtgacattcctttttaatgataagtagtgcctaaattttgttaacctcatgaggcttttgcagcacttgggacttggtctgtccagaagcctcaagaactgctcatctaacatgttttcctccacttttctttggtcaccagccaaagtgctggcccctgatcagctcaccctcatttctctcatctctgtcctattctgggacacccattccttaacacccatcattctttttactaccaatgcttgccttttattctagaacccttatctatcacctagcatctaccctacactgccaatctattcacagatgggttcttctactcccttctaaatagcatgcaagctaaaactttttattccctcttacttaactatagaaccccaaaattaagtagcagcattatgctttaactctccactgctgtattcagatcattatttgatgattataacaatacctacctcctctgagatgcctgttatcctctatccacccttactgatattatctgaagacttccttatccatcacctttttttgatttgtttgtttttgagatggagtctcgctctgtcgcccaggctggagtgcaatggtgcaatcttggatcactgctacttccacctcacgggttcaagcaattctcttgtctcagcctcccatgcagctgggactacaggcacataccaccacgtctggatactttttgtatttttagtagagacagggttccaccatattggtcaagctggtctcaaactcctgacctcaggtgatccaccggcctcagcctcccaaagtgctgggattacaggcgtcagccaccgagcctgactcccatctccactgtaatggacttagctctttcctgtcctacctaggataacatttcatttaacttctctcttgcagtaatgcccattgcccatgtctttttgatttttggttgtatctgacctactaacattccaaagtcaatcgatccacacatttttttcactgcacttgtagctaccccactgggtactgctgaaggaaattttaggaaatttcacaaaactgtggattgctgtgctaataacttatggtttccaaactcaattgagtcctttatgattcttaaaacttatgttcaaaattaaattcattttaattcctgaagcctgctattgcttctgtgtcacctgtcttggcaaatggcatcacccttgaaaccaaaggcaaaatccagatgttatcctagacctcttgtttttcatcaccacctttataactaataatttattaaaaacactgaattctattatcttagcagctttgttttgttaaagcaaatttaagatatctcatttcacctgcaaacacttcagcatggatctttatctgataccatttttaaagaaaacatcttggcattatcatacctaacaaaatactttccttaatgtcatctaatacctagttcacatttcattttcacccttaataacatttaattgactgtctaatttattttttatagtttgtttgaccagtcaaaattcaagtgattttgtgttttgtcttactatatcttgacctcttgcatgcttttttttttttttacaacagtccccctcattctttttatcttctacgctattgatttgttggagaaaccaggtcctgataaacattgtcctcaaatgtctcacattctggattttactgatccagtaaaatcgtgctgtttattctactatctatgttcctctattccctataaactgatttgattaaatgcagtataatttttttctaagtaagaaattttaatatgtgatgctctgtactgactatcgccccagttttagatctcctgagctcgatcagtaggttcaagtggtgtcagtctaattacttcattacaagattttccataaaatttcacccaatggtgttagcatctattattgaaagctacctaaatgtttttactaagggttgaataatggtgaatctataattatattatttatcctgaattttttaacttgaattcttctatagagaaaaacttttccttatcacttatttggttaccttgaaataaattcctgcagaaatacaaaataaatatttttttcatttatagaaaatttgaagccagaaacacaaaagagtgtagagattataccaaattatttttcagagtagttgtatcattttgtatccatgagaaatactgcataagtgatctggttatccctcatcctcaccaacacaagatattaacaaactgttctttcccactgtagtgagttataaatgatctctcaatgtggttttcatttttatttacttgattatttattagattgggtatcttttattggctgttcagattttctttctgtgaagtacctattaagatttttccctgttatttcaagtgagctattctttttcttgcaaattataagattcgttttatttatttttggatattgattaatcctttgcctcttatgtgtatttcaaaatatcatctctctgtgtgtagttcttcttcttttttttttttcattgattttgatggtcagaaatcagaagttctgatagtcatcttaatgcattttaaactttacctctgcagtttgtgcttttgtattttgtttaataaaccccatcctttttggaagtcataaatatactgtcttatagg

SEQ ID NO: 2513 - DNA, 753 bp, Homo sapiens
  ENST00000508675
atggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagtctaaatcaacaggagactgatgctgctcatatcttgaagaagcaactggcatccgtgatctttattcgtgacagaaattctcatgggcaagagatatcaggatacatcgactatgcccacaggctaaagacggaagattttgaagtctactttactggaaaaaaaagacttcttccaaggcctacagatataagcttttacaactgggacgctgatattgctgttagtaattcaagtcccaactatcaagtgattgccgataatccagaaggcttacttttcagatacaaaagagacagaaaaattcttaatgtggacccaaaggcgcagccaggtgacaactctactagaatcactatcctgacagaactctacgtacaagctgtcatttttgaccacatttccagaaggaagacttaa

SEQ ID NO: 2514 - DNA, 429 bp, Homo sapiens
  ENST00000503883
gaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagtgtaagtacatttcatccaacagcttaaaatgtatacactaaatgcacaattaatattaaaaaatgtaacattaaatatctttcttaaagtaatttacaagatataaaa

SEQ ID NO: 2515 - DNA, 268 bp, Homo sapiens
  ENST00000508314
cgactatgcccacaggctaaagacggaagattttgaagtctactttactggaaaaaaaagacttcttccaaggcctacagatataaggcgcagccaggtgacaactctactagaatcactatcctgacagaactctacgtacaagctgtcatttttgaccacatttccagaaggaagacttaagtaccaacatgttaatttcctaataatttgctaaatttaaataaattccgtagacagagcaaattagaataataaatgagccctg

SEQ ID NO: 2516 - DNA, 228 bp, Homo sapiens
  ENST00000621014
agcttttacaactgggacgctgatattgctgttagtaattcaagtcccaactatcaagtgattgccgataatccagaaggcttacttttcagatacaaaagagacagaaaaattcttaatgtggacccaaaggcgcagccaggtgacaactctactagaatcactatcctgacagaactctacgtacaagctgtcatttttgaccacatttccagaaggaagacttaa

SEQ ID NO: 2517 - DNA, 6170 bp, Homo sapiens
  ENST00000281146
gaagattgctggggactccacgttcaaccgaatcccacgctggtgggaagaggacgcggtcgatacaggcgtcccgcgggtcactctgggtctcgtcgggccacctaggagagtgccgcgggagcttgacggcagcctgagagcggcgttctacgcggagcggcgggggttggagaggacaacgccaagacggctgggaagccccaggccagcagcggaagtccactcggcccgccctgcgactttgaaaccggtgccccggaccactccttggagacggtggcgcctcttgcgtcatcacgcgggcgttggagcttacgccatcgcgcgtcctagagtcctagcacgctattggctggctgtcaagcaatgggaggagtcgtgagaacctggatgacagcgggctgagccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggtcatctcaagaagagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagaatgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttccggggtgattgaaatgttttgtattttgatctggatgatggttatgtagctgcatatatttgtcaacattcctcatgctgtatgtttagatttgtgattttactatatgtaaattaattccttaataaaatactattataaaataagctgtaaattaaatggaattaacttcaagtttacattgagtttatatgtttccattgaacaatcactagtgatggttaaatgtggcttatcgacttactcatttcttatatatgttctctatctaaaaagagagctggtgtaagataaatgctaacttttacaaaaggtattattaagtatcctgactacacatcatggtggcagtgttaggcatcttagataaattgagaaattattcttaaaactgacaatagcaactaattaatttgatatagaaacgatctgcctgttttagatacgaatggcatattttaaataacctaggacgatttatttataaattacctgaataattttataaatgcatataaaactatcaaaataaaaacaagatatattttagagcatcttgattttagaagcgaatcgaacactgtgaatcacagtttcagatataaatcataactatttataatatggataaaaatgaagcacaaatatgatagatacaatcacaacaatataaaatactgaatttgaatgttgtagcttgtgagctttctcaaatctaatgtgtatctttttaaaatttgtttagatgttttttaaacatctcttaactttctttcatctagataaggcatttccttttcttccaataccaagcaagcaaaaatacattatataaacattttcttttgaaaggaacatgcatatcaactacagaatttcggaaagcttgtccattagtcaggtacaaatgatatattctagaaacttgtatccaagaaacttttatttgagagtgggtgtttgtaatagccatttcaaatttgtttttcaacttcaggaccatgaaagaataatcatccttttgtttaaaatatgcataaatgcatttctttgctgtgatttgaattgttcactgcagtgtcaagcagattctctcttctcaccacctaaatagattacacaatgtgcatatttattcaggtgcattctcatgctttttcccagctccaggaaagtgtaagtcacagtctgaagggaaatgtgctttttatttttggctccaaactactttttttaaacgttaaaaaggttttttgccacaggaaaaaaaacatttaatttcccctccttctcctccttttgctccttttttaaatgttaggcttttggaggacagaagataatgagcataattaatctgatattgaaaaagaaagggtagcaagtggataaagcaattacagtaagccctcagcccttttctcatgcctcaaagcttaaggattgtctcttcttttccatgtaaatttccataatattttacacattgctttattacagcatttatttcactggtcctagatagctcttctgacccacctcctatcctctcagcctaactttttactccagccatcagttgcatacagtgaactgactggccagttgcctcagctgtactgtgtatgtcttacttcctgcccctagggcttctctgcttcctctgctgtgtggaacacttgcaggaacccatttagccattctctcacatgaactacccgggatgtgtgaagggactaaaacaccccatggggcacctcttgaccaaagagggtgggagttgatggataactacttctctgttacatccctcagtttaacaatttatggtcccttccacacagctcctcagaagttctcttaaaaggattccaccctgattacccacagcagtggccaactagtaacacatttttgcattatctttccttcatttccatcattttctgttttgctcttcctggtacctctctcctctctggaattgcttaactacagtcaacctctttggaagttattgtcctatgtttgcttcatggggaacccaggctaagtcagtgattacctaaagcagccctagaaagccgttcgtcaggatgagaatctagaattgtatcacagggcatttggtgacaaggaccccattgttggtggtaatggctctgctataagtaacttcacagttattaaaacagtggtagactggcttgaggtgcagctgaggcacctgaagctatgaaagccatctagtcataatgactcttcgtgtcaactgttcagcaggcaaatagaagcgggctaccatgcagagctagagttataactattaatggaagcagtatagagtatgtccttcctaggggattcattgagtcatcctttggtgtttcaatgtcaagtggtaatcttaaatgggcaactgtagcaaccacagcctgacaaggtaaagcaactaaggactctgaccctttgaggataaaggtctaggtcacctcaccattcaaaccacttgaaactactgaagagtttggccaaatgtgagagaaatacagaatttgtgatggaagagagagatgataactatcaattatagacttgaaatcagttacaggagccacataacttgttccactaaatcttttgcatttagtatttgtataatggctgcccacttccttgaagactctgtgacagattggactcaatgtggaatgtgtgtggctctgagtgctgcaaggagtggactgtatttaatatctcttgtgtcctacctcacatcctcttaggccatttttcaattcacccattttactctttgatagcactttacctcttttgtcccatgtatctctagatttctgtattagtgcttttctgacacctcagttatgtggaacacctgtgggaatctgctaatctactctgacgtatatgcaaacctggaagtttgagggaattgacaatagggacaggattcagtggataaatactccccttttccgtcccttgggcagacaattctgaagtgcattctgtatagttccttagtggtctccagtaggactccactagggtcttcagttacctacagtactgatcagcttaaaaatgcaatcttagattggcttgctttatttaatttttccaaagttcccaatcccattccttagaatcacattccaaaattaatgcactgcacacaaccctctgcttttgtcaggggtagaaggggtatccagcctaaggcacctaagtccaagaggaatatgtgcctaacaaatcttctaactaaatatatatatatatatatatatatatataaaatatatatgtttatatataacatatatatatagagagagagcataaaatgtgctgtgtatgtgtgtagcatattttttgttaaatcaccattcctgggccctactcattttctgataatttcttatcttaatttgctctgaaagagcaaaacttataaaattgactattgtaactctattttttaccaactatcatttttcatggaaggaatagtaaaaagagttacctctgaagctaagatgacacatgtatgaggaatataggaagccagaaatcatgaatctatgaaaagtgaggggtgtctgtgcatattttattttatttcataataaataaccagtaattaaaatattcttttccatgtaatgggatctacgagtaaatttttgtctgatatttataaatctaatatgtaatataaaggagaaataggaaatgctgtcaaatgacatttcactttactacttatttgaattacaatgaaataatatatagctacatcactggctcctgagagagctttgggtgttctgtaaattttttactttgcactcttgaaaaattcgcagagaatgcaaggtttagtaaaaatttattttcttttggcagcctatcacctgtaatttccgttaaacagcatttctgactcaatagtacactgaaagcccatgtttgtaataatgccctaaagcactgcagtacctagagtatatattttgaagagatagctttgctgaaatagaaaaccaaactgtaaattgaagtctgagcattcagagaaataaaaattatgctaaaaacaaacgt

SEQ ID NO: 2518 - DNA, 1126 bp, Homo sapiens
  ENST00000502887
gagaacctggatgacagcgggctgagccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggtcatctcaagaagagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagaatgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttgtaagtagaaaataaatgaagatatgttccaaatacacgagttttttcgaaattaattcttagtggagcagaagtaacacttttgatcaaagaagacgacatatgtgcacaagtatctagtagagtccaatgttcactgatggtcctcagaaaatacttggaaaactttggactgtcataatctctctcactactgtcagtagagcacttatttttccatagtggtatgagaaaagtgttgtttgcatgtgagaaaagtaaatgttgtaatagctgatatagaagtatggtcac

SEQ ID NO: 2519 - DNA, 519 bp, Homo sapiens
  ENST00000502360
gcagctgggtggagcctaaagccgagccctctcctgtgacctcggctgaaaagaagaagccagtgtttgagaaaagcttcgtgagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaaggtaagtggaagtactgtattttattgcaaacataaatcttcttataataacctctcacagaactattattttatcttgctgttgggaagtaagtgcttctgagcaattgacatgtacagtttctgatatttcctaccaatctctcattctgactttttctccattacctgtgtgactttaactatataacaaaaacagttaaaaaatggcaattacaaatccagattttttttttttttttttttt

SEQ ID NO: 2520 - DNA, 396 bp, Homo sapiens
  ENST00000508673
agctgggtggagcctaaagccgagccctctcctgtgacctcggctgaaaagaagaagccagtgtttgagaaaagcttcgtgagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtcccaagaacttcctttatcgttcagaatgtccagaggagagacaaaatgggaaggcaaagcttatc

SEQ ID NO: 2521 - DNA, 465 bp, Homo sapiens
  ENST00000508622
ggctgaaaagaagaagccagtgtttgagaaaagcttcgtggtctgtgttctctagttgttccctcttctctctgacattcctttcgtcgtcgccagaatttttgtggatttggtggttgtatgaagaataagtgaatctaccagaacttcctagtagctaagatcttgattcccagaggatccagtaactgagacacctgcacactttacaataaataaaagacaaaggatgacataagaacccatggtgcttatagttacaagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatt

SEQ ID NO: 2522 - DNA, 1588 bp, Homo sapiens
  ENST00000425929
gcagctgggtggagcctaaagccgagccctctcctgtgacctcggctgaaaagaagaagccagtgtttgagaaaagcttcgtgagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagaatgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttccggggtgattgaaatgttttgtattttgatctggatgatggttatgtagctgcatatatttgtcaacattcctcatgctgtatgtttagatttgtgattttactatatgtaaattaattccttaataaaatactattataaaataagctgtaaattaaatggaattaacttcaagttt

SEQ ID NO: 2523 - DNA, 4418 bp, Homo sapiens
  ENST00000374023
ggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgttggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacaccaaaaaaa

SEQ ID NO: 2524 - DNA, 4232 bp, Homo sapiens
  ENST00000374026
ggaggcggaggcggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctgatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgttggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacaccaaaaaaa

SEQ ID NO: 2525 - DNA, 916 bp, Homo sapiens
  ENST00000374021
gtgtaacctctcctgtttttgtacatgtgtttattcctgaactgttttgggctactcattgttaaccaggttgctgctctacttttcccactgctggctaaggaagattcaactttttcaggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttgggggg

SEQ ID NO: 2526 - DNA, 2223 bp, Homo sapiens
  ENST00000518698
agcctcggggagcagcccgggctgtttgttccgtcaccggggaaaggaggtacacacagtcgcgcgcgcacggacacacacacacacgcacgcacgcacacacaccggtggcgagttcgagccccgcggcccctgtccgcccgcgtgcgcccctcgacacagctcgcctcccgccccctgattcctgctgctgccgcccagaggagaaaggaacctctgcctcgaatttccccactgcgccgggcgctgcggagagcggcgagggtgggcgcgaggcggagaacgcgatgaatgagttctcccctcgcctcggagttgtctgagttggcggcgctgcgcccaggcttccggctctcagcgccccacgcgcgcgtggctccccgggctgccacccacgcccgcggccggggccgagccagccacgcagggcagccgaggctccggagctcctgtcccggccccagtccgggtaaaaggagggttgtccccagcggaggcgcacagccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctggaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtgaaacagagagaagaagttgcaagtggtccttaaagaaatgcagttattcaaatccttatgtatagttctaattttatttactatgtgtaatcatttagagaatggttatttttataatctcaataataaacaagtactatcgtagccagggggtgcccaagtatgtaatcagagaacactaatcctggcaaaggattgtggggtggtcaggaggccggctgccttttgacatggttagagtcctgggtttagattactttataaatagttattaagattaatatttgatatattaaatattgcctgattcaaataa

SEQ ID NO: 2527 - DNA, 648 bp, Homo sapiens
  ENST00000349492
cacgcagggcagccgaggctccggagctcctgtcccggccccagtccgggtaaaaggagggttgtccccagcggaggcgcacagccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcatgtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaa

SEQ ID NO: 2528 - DNA, 1948 bp, Homo sapiens
  ENST00000523686
acagccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcatgtaaggaagtctcttattcaaatgctattcaaagcatgtaagtttatgttgttaagaaaatgaagaaaaggtattaattgaagcccaacttttcatctgatatttctggcctttaatcttagtgaatttcacttttactccgcatttacattgatcttcattcatacgtatgtatttgcttgcttatattctcaaacatgtgtaattcacttggacccttttgagtataatattccttgaagaatataaactgcatggagcgggtctcttgtttctcatagccaattgtagcattacatcatattgaaagcagtagctacctatatttaatgaagtatgtaaaagcaaattaaatctcttagaatagaagcaaagaagatttctattcaaaacatttcataaaatttcttaaaaaatatttcatctgggattttcctgaagtcctactcattaatttgtgatggaagtccctatattctcttcactactactgtaatatctttgtttttatgttactacaaaggaatgactgaggttgggtattttataaagaaaaaaggtttatttggcttacggttctgcagactgtacaagaagcatgacactagcatctgcttcttgtgagagccgcaggaagcttccactcatggcagaaggtgaaggggtgcacgcatcatatggcgagaggaaggagaaagagatagcagagggaggtgccaggctctttttaacagtcagatcttgtaagaaccaacagagtgagaagtcactccttaccatgaggacagcaccaagccactcatgagggattgacccccataacccaaataccttccaccaggccccacctccgatattggtgatcaaatttaccatgtgatttggagaggacaaatatccaagctataccacctaagtatcccttctctctcaatggcctactgctttggtagctactgggattctccagtgctctgctatccccacatatgtataaacatgtcaaaaatctcaggagcctctagcaaatcacagctattcttggaagaaaagagaacttgcaagctgttcttcttatacatcaattccttgtgcttgttacagggtgagatgtttgattttagtttcaacagagaaaggagtaggcagaaaatatttatctttgtttgaaaatgtttgaaaaaccactatgtgctaactggaatctgcatctgggtcatttgtgaaagcaactaaatttaactttgtgagcagcttcatttacatagtggtactcataaaaagtattgcattaaccacaccaagttcttgtgagaattatatgaagtgttaacaacttaaaatgttcttcagaaattgtgattgtaaccaaattgtcctgcttcatcagtttggtatatagaattaggtcccaacattttaaaaaatatacaagtttaaaatttgcatgtcttttttacaacagtatagccagtaatatccagcacagtgcctgtttcaattaataaatgctaaatgataaaaatgaataaaggaagaaataaaaaatg

SEQ ID NO: 2529 - DNA, 3571 bp, Homo sapiens
  ENST00000348340
gccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctgggtaattttaaaaattaataatttctcattttcttctttgacattgtaaaaaaaacgtgtggtgattaagagattttaaaagttttgaatagccttgtcttagggaaaagaaaccatttagtacatattttatttacattagactcacataaagttgcatgtaagaactaaattgaaataccctaagcatatgaatatttattagactgtattttgtgctttgtgtatgctgcactttaccttctgactacgtaatgaagcgttattctgtgtgcaactgtgatcaaaattcaagtctgtctgctttattctctgataataattgccttgtttacatctattgtctataaaatatacccaaagtacatatttcagccctcactccaaaatgtctaccttttattttgaggatgctttagaaaaatagaataaagttgaaaggggcagatagtaaattcaggttttatgttttccgtaaatgacgggaaagtttgcagagatttcaaagtttcttcaggcctgttactttcatgaaaccttattaatcttgtatatgtaggatatctttttatattttttaatgtagtatatgtatgtttttgcttcatcagaaatctcttcatataaatttttaaactgaacttctctttggaacatcatttttctgaagaaagaaaatgaaatgttatttcagagtgatccacatataaaacaatgagttttgaagtcagtggtatcaattattctgctacaaataaagagtatgattttcaaatactttataacaatatgctgttgtattttatttagaaagagaataaataatataattatttgaaagccttaaacacgttttacatatagaatatggaatctcagaaaaatataggccattttctgaagtttttgttaaaaatgagattccttggttttaagtgtttatggcagtaaaatactatcattataaaaaatgatatattgcttatcatttttgcataggcctacaaaggtgttatttggtcaatggtgacaggtttgaaagatgttttctgatgctgtaaaaactgcattcatgctaacattaaggagattgtatcatggcgttttcattacatgctgttggtcccttccaattgggtcttttcctcacctccaaatcattaacatggcagacgtgccctatgtggcagtggtagcttcattcaacaaacatttactgagcacttactctatgctaagcacttggctggggtctgggaacataaaaataaaatcattgtgatctgtgtttgaaggaattttacattgtaatgttcaagatacaatacgtcactacctgtgctaactgcgctaattggatgaagcacacagttgtgtataggggtaacacctaaagcagaggtaagggacagtgacccaggaatgtttcctagagaagccgattactctggctagtcctgaaaagcaaatagatgtaagctcagcaggtggggtgtggtcattgtaggtttgctcacgtaggtatgggctgttttgcgattgtgctccataactatacctgtaaatggttcctctgctttggacagtaacagggaaggggcaactgagatccagggtttctttcaggagatgcagttgtccactccatgctggtactccctagatctcagctgccctgactgaaggttctagtctcccaagctgaagaccgaggattgagtcttggagactatctaatgatgagcaattaataactagtcctcattaattctttttttagacattttagcctgtggtctgagcaagtttaataataagagatagttgaaggtttggactttcttcatgtaattccacatatctcagcacaggtggcaagcagtgtaataatgttggtctctaggtcatgagattatcctcttatagcttggaatgttacaagtccactggactttatcttaaaataatgccatattcaatttcttgtttttgaaatggattccagcaaaatgtatgtgattgtgtctatttcagaaaaatataaatgctaagttcttggaaatttatgtgaaatctaattttatagagtttatatagaatcattgtaagatgcaatagagacatctggtatttaaaatctttttgaatctacattttgtagatgtgtgtgctatagcttatgtgtttgtaaatgtttaacttgtctttgttatctataccaagatataactggctgaaaaatatttattatgcatggaaagcactctgtaaaccttgtgaagtgataaataagtgaaaggtataattgttagttgacattaatataaaaaaggattattcttcaataaaattggttgatttgaagggaaaaaatccttttagttgaactagtagaagttagtaataactattgactcttgttttgtttattaaggaaactagcattgttaatatatactgattaatatttaattattcacagttgtttaattatatatttgtggatttcttttctaaatgttttaggcatatgaaaatattatagtacaacacctgtaatttttaagtagatcaaatattttctgtaagattgctttaaatgctccttataaattcacattgcaaaagtaacttaatatggaattaacacttgtcagataataaaacagccaaacttgt

SEQ ID NO: 2530 - DNA, 3652 bp, Homo sapiens
  ENST00000337103
gcccaggtaaagccatgttttcctacacttaaaaatgtaaataaatatcccttagataatctggacagcagtttcttatatagcatgtctgagcactatattttgctgggctataaaaggtttaattgttgtttattggtacaataagggattctagttactaatatctacctgtagtcaataaagcaaacattgattggttgatcgaatcattgattcattcaataggtattgattcagcaccagctatgagctaggcagagttctaggccctacagagaaaactgatatcaaactaagaaagtctttttccaagtgctacagtaggggtgggggaggagagagataacaaactggtgagcaaatgttaaacaaaatgattctagagagtgctaaatactgtgaggaagataaaatgataaaataataaagacttctgaagattggttagggtaacctcttgtagaagtatcattggagaccgaaggatgacacaccagccatctgaccatgagagaacatcattcaaggcaaaggaaacagaccaccaccaacaaaaaaagatgcactggggaatttccagtaacacttttgttagctctcttaatatctgattttttgagcactagaacactgcctctcacagaatcctagcttaaaacagcaatgaacagactagaattctaggctaaaaccaacaagatgaaatgtgactgatatgaatataaatggtgcacataagttcacaaacccaattacacagcacaaaatgatatccacgtggcttgacagctgttcatattagaaaaatctagggattctaatggactacatattggagattgctctttgctgttcctgactggaaaaaaaaatatgtagatattacccttgggcagatttcagcccaacttaaagtatcattagagctgtccaaaatggaacagcctgctttgcacatagagaactcacattgctcaactcaaaaaagagcagaaggaaggaagaaggaaggacacgtaacagggatttttacaaaaacagaattcggtatttcttggagactactttaagacagtttttggtttctgtaagtctgtgacttattacttgttcctttaattccaataaaattttcttcatttttgttatttttaaaacattaagaagaaaaaaatgatattgatataaggtagatggtgaagtttagcaaaagtttagtttataatgatatctctcaaaatagcaaactgaagtttaaaattcttaagctataattttaaaggaatttagattaaacttttaatatgttgttggctaagtataatacaaaataaaaactaaataaatcttggttttgccacatattagctgtgtaatatagacaatttacttctctgttattgtttcctcagaatgagggcagtaacttgtagccgtctgaaaagattgttataagcatggagttagttgctgtatataaagcagttagaccagtacctgacaatattacatgctaagtaagtgcttgctattactgttgctgttattattaattataattgtgtgctctattctgccttcaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctggaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtgaaacagagagaagaagttgcaagtggtccttaaagaaatgcagttattcaaatccttatgtatagttctaattttatttactatgtgtaatcatttagagaatggttatttttataatctcaataataaacaagtactatcgtagccagggggtgcccaagtatgtaatcagagaacactaatcctggcaaaggattgtggggtggtcaggaggccggctgccttttgacatggttagagtcctgggtttagattactttataaatagttattaagattaatatttgatatattaaatattgcctgattcaaataactttgcttaaaatttttctgtattttaacttgtctagggttttctacttcttctatttttataatattttctcattttttagattactaaacattctacttatccacatgtgccaagatgtgccatttaggtctctgcagaaattagctgtttggtatcatcacctgccatacatgttgtgtgcagcagtgagaagtatattctctaccactgctctttctcatgattattttctctattcctattaaaatgaataattgatatgttaattaagtaaagcaaatcaataaggaatgaaatgcatggcccaaaacatagaaaatgaaaatcgtttgaccatttatccaattattgaacccaattaagatgatccattttaaatttaatatatgctcgcttttggaatgtgttatgcattgatgttaagtgaatggatctaagtaaatctattgatatctcta

SEQ ID NO: 2531 - DNA, 1428 bp, Homo sapiens
  ENST00000521406
tgtgtgctctattctgccttcaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagtttagaagacacgtaatgcaatgatgcagaggacagatgccatggcaagagactgaagctaaataaacttcttccttccattttcaacttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctggaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtgaaacagagagaagaagttgcaagtggtcc

SEQ ID NO: 2532 - DNA, 464 bp, Homo sapiens
  ENST00000518515
cagcaacagcaacataagaaactcctggccgcaatgctctctcaagattcttttgagtccatccacagccctaccccatctgtaacagaagaagatattgataatgaagatgatgcaatggaattgctgggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctgatgaatccttaaagcaattgcaggtagttcatcaaccatggatcttgccaagtgacacagaaagtgaaggagtggaagcagaacaagagaaacgtgagtagacactattgtttattgacaaatttcttttaccagaaggaaatccacaataaagctatttcactttcata

SEQ ID NO: 2533 - DNA, 2281 bp, Homo sapiens
  ENST00000325233
aagaaaatgaaacagaattgaaaatggtcttgtaaaattccacttggggtggcgatgctttgtggcttgaagtgtaagggatgagaacagcatgtgaattccaagaaagcaacacagaatggaaaatggatttacaatgtgtcagacagggaggcaacatcctgtggcatgtggcttgcatctcagcggtgggaaagaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacacctactaaatcagaatctctgtggctgggactctgaattctgcatttttcatactttggcttctttcctcatctataaataagtttgaatataaaatgtgagtctggagaaaaaggaaggctaaaatttgaagaaatatacatggagaagacatgcaagacagtgtattagtcggttttcacactgctataaagaactgcctgagactgggtaattgtaaagaaaaaaggtttaattgactcacagttccccatgtctggggaggcctcaggaaacttacagtcatggcagaaggaaaaggagaagcaagcactttcttctaaggagagagagagagcagtgaaagccacacatttttaaaccatcagctctcgtgagaactcattatcaagagaacaacaagggggatatctgcccccatgatccaactacctcccaccaggcccctcttctgacacatggggattacaatttgacatgagatttgggtggggacactgagccaaataatatcagacaggtcctccagactgtgggttcaatgcttacaaaatcaaaacacaaaacatttagaatcaatttagccagtaccctctaattacattttagatttttaaaaacacaaataaataagctaaaaacacacaagcaaacaaacaaccaaaccaaaccaaaccaacaaaacaacacaaatgtcccaaataaagaaataatagccaaagtcacagatgaaagctaatgctgtcataaaacattaagacttccccacttgggtttgggtcctagttcttcctgaggtcttaatgtctgtaacaataggtaatttggccctgggtctccttaaggcagggagattgagatgatgacacggtatagagcctgtcacctgcaaggactgactcaggtataaaaagggaaataaaatacctgtactctctaactgtggaacaagccatgaaatttgctattggtattagactttgaacgaaaaatgtaaagatacacatagggaatcaaactctcagctctgtactttggttattcggttcaaacttaaactatctgtattgtcagaaaccccacattataataacaattggccagcttcattaaaattcacagggtcctctcatgtgtaaatgtaagaactggggcatttagaactcccaaagatttaaatatcaactcctgctgaagacgagctctcaatcaaattacaagctgcctgaaaagttatagtaaaacaacagagtcagcaaatgctaaaaacactagaattagaatgatgagaaaggaaagaaataagacaatcagaaagagaccatattaaaagtatgcttaagatatttaaagatatagatcaggcgcaatggctcacgtctgtaatcccagcactttcggaggccaaggcgggcagatcacgaggtcaggagatcgagaccatcctggctaacacggtgaaacgccgtctctactaaaaatacaaaaaattagtcgggcgtggtggcacacgcctgtaatcccagctactcgggaggctgaggcaggagaatcgtttgaacccgggaggtggaggttgcagtgagccgagatcacaccactgcactccagcctgggtgacagagtgagactccatctc

SEQ ID NO: 2534 - DNA, 590 bp, Homo sapiens
  ENST00000482608
ttcctccatcccagcaccagccgactttcttgccttgttctgcacctctcttcttgtctttgttcctcttcttcctaccacacaaggggcaagagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccagtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatggg

SEQ ID NO: 2535 - DNA, 570 bp, Homo sapiens
  ENST00000519702
ctaggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccagtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggatccagacatctcaagaagatgactgaagagtatccag

SEQ ID NO: 2536 - DNA, 478 bp, Homo sapiens
  ENST00000498712
acagtagccagacgtctgaatgtgactcaccaagaggagtgtttggtattcatattgatgatgactctgtagaggaagaatttaaaggtcaagcatgaagaaacagatttaggaagacttggtgtttttatctggatacccatcattctggcccttacaattagagattatggaaaagagccctctgtggccccctaagcctgtaggtctgtgtttttcagttttgctggccgagaaaaaagacccaagggagtaacatattattttctacaaggatgttctaaaactgctcaggcctgtgagtgaaatgatttgctgcactgcaagggagggtctttcacagacgaaaggttcttaatttgatgaagttcagtttatcaccttttcctttttattcatcatgcatttgatgtcaagtcaaagaactctgcctacccataaatctctaaggttttctcccgagtgttttcctaaaaat

SEQ ID NO: 2537 - DNA, 305 bp, Homo sapiens
  ENST00000470796
agagccctctgtggccccctaagcctgtaggtctgtgtttttcagttttgctggccgagaaaaaagacccaagggagtaacatattattttctacaaggatgttctaaaactgctcaggcctgtgagtgaaatgatttgctgcactgcaagggagtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttg

SEQ ID NO: 2538 - DNA, 208 bp, Homo sapiens
  ENST00000490228
caaggatgttctaaaactgctcaggcctgtgagtgaaatgatttgctgcactgcaagggagggtctttcacagacgaaaggttcttaatttgatgaagttcagtttatcaccttttcctttttattcatcatgcatttgatgtcaagtcaaagaactctgcctacccataaatctctaaggttttctcccgagtgttttcctaaaaat

SEQ ID NO: 2539 - DNA, 3513 bp, Homo sapiens
  ENST00000305454
atttctgaaatgagaaagggaattgctggtaccaaaattcacgtttcctttttggtggaaattctccagccaagcttggcgctaacagagtaggcgatttcacttcgtcgtcacctcacaaaaggcttccaaattcactgcggcagacaccgcaaaataaaaatgttaaatacatcctagctgggaggggattgaagcctccaggctcaatcaaaggtttgcaataataggattcatttaaaaaaaaaaaaaaaaaaaaggacagatgggtttagaaaatgttgcagtgaagactggaacgagatgagctcatagcaccagcctgtcttttgtggacccgcacaatgatccctgagccagactggattaggatgcctcgcgactaggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtgggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaagcactatatataaagttagtagttctaatatccacttgagagtatactcaagattgattttcatggccatttggcatgattgcatgaattctctattcttttatgtgcagtttttctatagaaaaacattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaagaaagcacaattattcccaatctgcagagggggaaatggaggccttcagagattacaggaccagataccaggtagtggaaccagacagcaggtccttaacttctctccagtggactccctgctttgcctactctctagcaactgacttggggaagtttttaaatggtgagagtgtgtctctgggggcaaccattgaaaagaagactctgatatgttggaacaagtaagggatttgaatgaaatacactattatatcttatatgttagcttgaaccagaaaaagttgacatttttgtaggtcaaaaacaattgagcatcaatttcatatggttcaacctcatatatgatactatgcttttcttctatcagtgaaaatgtcatcatcaattccattgtcaacattagtagccttaaaacaataacataataataatgatgataatgatacttatagctatcatctattaaatgcctatgtttcaggcatgatactaggcaatttatatatatcatcctaatctttctaaaaactctattaggtggccctatccacttaatagatgccaattcaaagaggttaaatgattagactaaggcacctaacttatgtgagtgtcaggcttcaatgcctgtgttagagctactccttcacacaaaatagttcagaacatagagaaggaccaaggttaataaatgattttcatcccaaacactaaacatgattgatgggtagaggctgcccgaagtactgtgtaaagatggaatctgagatagaagaatgctgtggtcaattagtaattcttgcccatggagggattagtgacacatgccttgtatatttgtcatctgtggcctaaactctgcccctgaaggtttgttttctaattcagaggtttaaattaatctagcccacttaataaaaccagagatcctatgggaaatttagcctaagacagtgctggaaattgccatatgttgatacaaagaagtgtttggccacattacaggtctcagactcaactgctatgtgtgactgccgctctgtgcctatgtcttgcttttttgctgagttccctatttccatatctccaggtgaatccatgagaagcgagagggtggctgagaggcctgggcctctgggattccaccttgctatctctgctcttcaaccattgttttagactctgaacaccagatcctcatatctgaaagtgatttggagacctgggcatcaagtgctcttttaagaaggggctatcccagaggactgttcaaaagtctcattcaatagagatgttggagtccagaacaaagttagggagcaaaccagtaacctatgctggtcgtaacagaggatcctacaattacgtttgtttttaagacaggattttgctgtgttgcccagactggtctcaaactcctgggttcaagagatccatcctcccacctcagtctcctgaaagctgggatgacaggcacatgccaccacacctagctccttacaaccatttattttaacttatttcatttataactggtatctttcatttgtatgtggcagctagagatttatataggatggaagtaatttatttttaatttaaatatttcatgttgaactgtttgccttgtatggaacattttacttggccaattcaaataaaaataaagtcagctttgtttgtgacattcatgcaccaccataa

SEQ ID NO: 2540 - DNA, 557 bp, Homo sapiens
  ENST00000521495
tagcaccagcctgtcttttgtggacccgcacaatgatccctgagccagactggattaggatgcctcgcgactaggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgatccagacatctcaagaagatgactgaagagtatccagcccttccccaaggagcagaagcctctctaccactgacaggcagtgctt

SEQ ID NO: 2541 - DNA, 346 bp, Homo sapiens
  ENST00000521813
caatgatccctgagccagactggattaggatgcctcgcgactaggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatagatctaggtgacaaataaggagaagtgtgaatcaaagacgtcagcagatgggatcctgaggcttgtgtgttagcccgtgtcttctgcttttcctatcttgacctctctatgaccagcaag

SEQ ID NO: 2542 - DNA, 3313 bp, Homo sapiens
  ENST00000460144
gagccagactggattaggatgcctcgcgactaggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatattttgtcgctgttcctagaattcactggaatcacgaaggatccagaaactccctcgatgcgagctccatctgcaaagctcctgccctggggttccatgggtccctaggcccgagcagaggagtgggctaaccgcgtttcccccgcccggcaggtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtgggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaagcactatatataaagttagtagttctaatatccacttgagagtatactcaagattgattttcatggccatttggcatgattgcatgaattctctattcttttatgtgcagtttttctatagaaaaacattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaagaaagcacaattattcccaatctgcagagggggaaatggaggccttcagagattacaggaccagataccaggtagtggaaccagacagcaggtccttaacttctctccagtggactccctgctttgcctactctctagcaactgacttggggaagtttttaaatggtgagagtgtgtctctgggggcaaccattgaaaagaagactctgatatgttggaacaagtaagggatttgaatgaaatacactattatatcttatatgttagcttgaaccagaaaaagttgacatttttgtaggtcaaaaacaattgagcatcaatttcatatggttcaacctcatatatgatactatgcttttcttctatcagtgaaaatgtcatcatcaattccattgtcaacattagtagccttaaaacaataacataataataatgatgataatgatacttatagctatcatctattaaatgcctatgtttcaggcatgatactaggcaatttatatatatcatcctaatctttctaaaaactctattaggtggccctatccacttaatagatgccaattcaaagaggttaaatgattagactaaggcacctaacttatgtgagtgtcaggcttcaatgcctgtgttagagctactccttcacacaaaatagttcagaacatagagaaggaccaaggttaataaatgattttcatcccaaacactaaacatgattgatgggtagaggctgcccgaagtactgtgtaaagatggaatctgagatagaagaatgctgtggtcaattagtaattcttgcccatggagggattagtgacacatgccttgtatatttgtcatctgtggcctaaactctgcccctgaaggtttgttttctaattcagaggtttaaattaatctagcccacttaataaaaccagagatcctatgggaaatttagcctaagacagtgctggaaattgccatatgttgatacaaagaagtgtttggccacattacaggtctcagactcaactgctatgtgtgactgccgctctgtgcctatgtcttgcttttttgctgagttccctatttccatatctccaggtgaatccatgagaagcgagagggtggctgagaggcctgggcctctgggattccaccttgctatctctgctcttcaaccattgttttagactctgaacaccagatcctcatatctgaaagtgatttggagacctgggcatcaagtgctcttttaagaaggggctatcccagaggactgttcaaaagtctcattcaatagagatgttggagtccagaacaaagttagggagcaaaccagtaacctatgctggtcgtaacagaggatcctacaattacgtttgtttttaagacaggattttgctgtgttgcccagactggtctcaaactcctgggttcaagagatccatcctcccacctcagtctcctgaaagctgggatgacaggcacatgccaccacacctagctccttacaaccatttattttaacttatttcatttataactggtatctttcatttgtatgtggcagctagagatttatataggatggaagtaatttatttttaatttaaatatttcatgttgaactgtttgccttgtatggaacattttacttggccaattcaaataaaaataaagtcagctttgtttgtgacattcatgcaccaccataa

SEQ ID NO: 2543 - DNA, 3227 bp, Homo sapiens
  ENST00000450307
agccagactggattaggatgcctcgcgactaggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatactctacttgaccaagggtaactgaaaccatagatgaaagggactactgtatactatcagcaaatcctgagaagctgcagaagagaggggttaggtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtgggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaagcactatatataaagttagtagttctaatatccacttgagagtatactcaagattgattttcatggccatttggcatgattgcatgaattctctattcttttatgtgcagtttttctatagaaaaacattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaagaaagcacaattattcccaatctgcagagggggaaatggaggccttcagagattacaggaccagataccaggtagtggaaccagacagcaggtccttaacttctctccagtggactccctgctttgcctactctctagcaactgacttggggaagtttttaaatggtgagagtgtgtctctgggggcaaccattgaaaagaagactctgatatgttggaacaagtaagggatttgaatgaaatacactattatatcttatatgttagcttgaaccagaaaaagttgacatttttgtaggtcaaaaacaattgagcatcaatttcatatggttcaacctcatatatgatactatgcttttcttctatcagtgaaaatgtcatcatcaattccattgtcaacattagtagccttaaaacaataacataataataatgatgataatgatacttatagctatcatctattaaatgcctatgtttcaggcatgatactaggcaatttatatatatcatcctaatctttctaaaaactctattaggtggccctatccacttaatagatgccaattcaaagaggttaaatgattagactaaggcacctaacttatgtgagtgtcaggcttcaatgcctgtgttagagctactccttcacacaaaatagttcagaacatagagaaggaccaaggttaataaatgattttcatcccaaacactaaacatgattgatgggtagaggctgcccgaagtactgtgtaaagatggaatctgagatagaagaatgctgtggtcaattagtaattcttgcccatggagggattagtgacacatgccttgtatatttgtcatctgtggcctaaactctgcccctgaaggtttgttttctaattcagaggtttaaattaatctagcccacttaataaaaccagagatcctatgggaaatttagcctaagacagtgctggaaattgccatatgttgatacaaagaagtgtttggccacattacaggtctcagactcaactgctatgtgtgactgccgctctgtgcctatgtcttgcttttttgctgagttccctatttccatatctccaggtgaatccatgagaagcgagagggtggctgagaggcctgggcctctgggattccaccttgctatctctgctcttcaaccattgttttagactctgaacaccagatcctcatatctgaaagtgatttggagacctgggcatcaagtgctcttttaagaaggggctatcccagaggactgttcaaaagtctcattcaatagagatgttggagtccagaacaaagttagggagcaaaccagtaacctatgctggtcgtaacagaggatcctacaattacgtttgtttttaagacaggattttgctgtgttgcccagactggtctcaaactcctgggttcaagagatccatcctcccacctcagtctcctgaaagctgggatgacaggcacatgccaccacacctagctccttacaaccatttattttaacttatttcatttataactggtatctttcatttgtatgtggcagctagagatttatataggatggaagtaatttatttttaatttaaatatttcatgttgaactgtttgccttgtatggaacattttacttggccaattcaaataaaaataaagtcagctttg

SEQ ID NO: 2544 - DNA, 582 bp, Homo sapiens
  ENST00000484919
aggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctggtaagtaaaataagcctgcttagttgtatctgttgtgcattaaacttctggtcatgtctgattctcctgtgccatgaagagagactcagtgttctttgttccaggcctgaggattattagaaaagcataactggcagttctttgctcccaaaagctctcagttggccctaatttgtacccttg

SEQ ID NO: 2545 - DNA, 1347 bp, Homo sapiens
  ENST00000522977
agaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtgggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaagcactatatataaagttagtagttctaatatccacttgagagtatactcaagattgattttcatggccatttggcatgattgcatgaattctctattcttttatgtgcagtttttctatagaaaaacattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaa

SEQ ID NO: 2546 - DNA, 865 bp, Homo sapiens
  ENST00000480005
acttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagagggtaagtgctgcgtctctggccccactgcctgtggcctcccactgtcctgatccttccttccccagaagagcaccaggccgcctggttgacagaccctcgagaggccaacacaaacccatgccagctgcaaattatcttttaatgaggccaataatcctgggtctctgcagcgcctcatcaactgtttccctaggattaagcaggagggtttttcatggtttccacttcattaacgccactctttaggcttggagaagtcatttgggaggttttttggttaattagatgaatgtaatcacgagccatattcagaacctcccataggcatgcaggcgtcagaaatatctcatgagtaagttcaagatcccctgcccaccggttaagaagtgtgtcaagtacaaag

SEQ ID NO: 2547 - DNA, 565 bp, Homo sapiens
  ENST00000485639
gatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggacagtgagtcttcaactcgattcagcacatacctgtatgccctggactacatcctccacaccgcaggcagcagaaaaggcgtttcagggtggtgaagggttgggttattttctcagatctgctttct

SEQ ID NO: 2548 - DNA, 536 bp, Homo sapiens
  ENST00000488582
acattcaaacaattcctttcttcccctgtgtcagccgctgacagggccattgcacagtggggcagggagagattccgtttggccacaaagagacagcctgcaggacataaattaagctttagacatttactgccagatccagagagagggaaaagagctgggagtctgctgcccacgtgcaggagttggaattccctctggaaactctgaaagtccaagttgaccctcggaatcagcagtttcgcttttgggtggaactcctcttacccctggatgttcacggtggcattgattctaagaaggcacaactgaaaataacctgagtgtccatgaagaggggaatggttaaaatgtggtgctgtcatgctgtggaatactatacaatgtcaacaggaataaactagatgtatgcctgtgaacataggtagatctaagcataatgctgagtgccaaataagcaggctgaaaaattatatattatccagtccagccagaagaagagccaaaagctctcagcacctcttgaccaagaatgt

SEQ ID NO: 2549 - DNA, 590 bp, Homo sapiens; identical to SEQ ID NO: 2534
  ENST00000482608

SEQ ID NO: 2550 - DNA, 570 bp, Homo sapiens; identical to SEQ ID NO: 2535
  ENST00000519702

SEQ ID NO: 2551 - DNA, 478 bp, Homo sapiens; identical to SEQ ID NO: 2536
  ENST00000498712

SEQ ID NO: 2552 - DNA, 305 bp, Homo sapiens; identical to SEQ ID NO: 2537
  ENST00000470796

SEQ ID NO: 2553 - DNA, 208 bp, Homo sapiens; identical to SEQ ID NO: 2538
  ENST00000490228

SEQ ID NO: 2554 - DNA, 3513 bp, Homo sapiens; identical to SEQ ID NO: 2539
  ENST00000305454

SEQ ID NO: 2555 - DNA, 557 bp, Homo sapiens; identical to SEQ ID NO: 2540
  ENST00000521495

SEQ ID NO: 2556 - DNA, 346 bp, Homo sapiens; identical to SEQ ID NO: 2541
  ENST00000521813

SEQ ID NO: 2557 - DNA, 3313 bp, Homo sapiens; identical to SEQ ID NO: 2542
  ENST00000460144

SEQ ID NO: 2558 - DNA, 3227 bp, Homo sapiens; identical to SEQ ID NO: 2543
  ENST00000450307

SEQ ID NO: 2559 - DNA, 582 bp, Homo sapiens; identical to SEQ ID NO: 2544
  ENST00000484919

SEQ ID NO: 2560 - DNA, 1347 bp, Homo sapiens; identical to SEQ ID NO: 2545
  ENST00000522977

SEQ ID NO: 2561 - DNA, 865 bp, Homo sapiens; identical to SEQ ID NO: 2546
  ENST00000480005

SEQ ID NO: 2562 - DNA, 565 bp, Homo sapiens; identical to SEQ ID NO: 2547
  ENST00000485639

SEQ ID NO: 2563 - DNA, 536 bp, Homo sapiens; identical to SEQ ID NO: 2548
  ENST00000488582

SEQ ID NO: 2564 - DNA, 873 bp, Homo sapiens
  ENST00000377197
gagacgccgaatcttggtacttacgttcctgccgggcaggacaggtgcatagggaactcctcagaggtctgtacctcgagggctcccatggatagccttgacagatcctgccaggactggtgcgacaggaagcaacactggttggagatcggaccaccggacttggtggagcgcaagggctccctgaccctccgctcccatcacaagaaatactcgaagccggtgttggtgtattcctggcaccgtgacagagaagcttttcccaaaggttatgatatagagggtcctgagaaagttaaaaaactgtgtaattcaacatatcggcgactgggaaccgatgaatccccaatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgtgtgcattgacaacgtactcagaagattatgttccaccatatgattatcagccacatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatgattttctatcttaataaatgcaatggaagtgttactata

SEQ ID NO: 2565 - DNA, 748 bp, Homo sapiens
  ENST00000527647
ggcaggacaggtgcatagggaactcctcagaggtctgtacctcgagggctcccatggatagccttgacagatcctgccaggactggtgcgacaggaagcaacactggttggagatcggaccaccggacttggtggagcgcaagggctccctgaccctccgctcccatcacaagaaatactcgaagccggtgttggtgtattcctggcaccgtgacagagaagcttttcccaaaggttatgatatagagggtcctgagaaagttaaaaaactgtgtaattcaacatatcggcgactgggaaccgatgaatccccaatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatgattttc

SEQ ID NO: 2566 - DNA, 697 bp, Homo sapiens
  ENST00000529446
ggcaggacaggtgcatagggaactcctcagaggtctgtacctcgagggctcccatggatagccttgacagatcctgccaggactggtgcgacaggaagcaacactggttggagatcggaccaccggacttggtggagcgcaagggctccctgaccctccgctcccatcacaagaaatactcgaagccggtgttggtgtattcctgatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgtgtgcattgacaacgtactcagaagattatgttccaccatatgattatcagccacatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatgattttc

SEQ ID NO: 2567 - DNA, 825 bp, Homo sapiens
  ENST00000529131
gcaggacaggtgcatagggaactcctcagaggtctgtacctcgagggctcccatggatagccttgacagatcctgccaggactggtgcgacaggaagcaacactggttggagatcggaccaccggacttggtggagcgcaagggctccctgaccctccgctcccatcacaagaaatactcgaagccggtgttggtgtattcctgatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgtgtgcattgacaacgtactcagaagattatgttccaccatatgattatcagccacatgttcttccctatcttcctcctcttcatttcaactcttctctaagccttcatagcaaaggatattttctctacccatttggagaactctataatctcccaggtttgatcattgacattctaaagtcctcaaaactgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatga

SEQ ID NO: 2568 - DNA, 794 bp, Homo sapiens
  ENST00000466872
gcaggacaggtgcatagggaactcctcagaggtctgtacctcgagggctcccatggatagccttgacagatcctgccaggactggtgcgacaggaagcaacactggttggagatcggaccaccggacttggtggagcgcaagggctccctgaccctccgctcccatcacaagaaatactcgaagccggtgttggtgtattcctgatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgtactgctgctactactcaggaaatcaccacaacctgagggcctggcaagaattggtggttaccacccaggtgtgcattgacaacgtactcagaagattatgttccaccatatgattatcagccacatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatgattttctatcttaataaatgcaatggaagtgtta

SEQ ID NO: 2569 - DNA, 502 bp, Homo sapiens
  ENST00000495399
ggaagcaacactggttggagatcggaccaccggacttggtggagcgcaagggctccctgaccctccgctcccatcacaagaaatactcgaagccggtgttggtgtattcctgatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgttagtagtccctaaactgctacaactgtacaaaatgtttcttgattcagaaggtttgtttgcaggggcaaaggtatgacagggtgagccaaggtcaacaaaatgccctttacatgacatcttcgacttgcctttaaccaaatgttttctcctttcacatgcacaacattaataaccgtaataataaaacagtaaatcctca

SEQ ID NO: 2570 - DNA, 550 bp, Homo sapiens
  ENST00000480564
ggagcgcaagggctccctgaccctccgctcccatcacaagaaatactcgaagccggtgttggtgtattcctggcaccgtgacagagaagcttttcccaaaggttatgatatagagggtcctgagaaagttaaaaaactgtgtaattcaacatatcggcgactgggaaccgatgaatccccaatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgttagtagtccctaaactgctacaactgtacaaaatgtttcttgattcagaaggtttgtttgcaggggcaaaggtatgacagggtgagccaaggtcaacaaaatgccctttacatgacatcttcgacttgcctttaaccaaatgttttctcctttcacatgcacaacattaataaccgtaa

SEQ ID NO: 2571 - DNA, 3200 bp, Homo sapiens
  ENST00000380003
gcgcaggcggtggcgagtggatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaatgccatcagctcacacttgcaaacctgtggctgttccgttgtagtaggtagcagtgcagagaaagtaaataagatagtcagaacattatgcctttttctgactccagcagagagaaaatgctccaggttatgtgaagcagaatcatcatttaaatatgagtcagggctctttgtacaaggcctgctaaaggattcaactggaagctttgtgctgcctttccggcaagtcatgtatgctccatatcccaccacacacatagatgtggatgtcaatactgtgaagcagatgccaccctgtcatgaacatatttataatcagcgtagatacatgagatccgagctgacagccttctggagagccacttcagaagaagacatggctcaggatacgatcatctacactgacgaaagctttactcctgatttgaatatttttcaagatgtcttacacagagacactctagtgaaagccttcctggatcaggtctttcagctgaaacctggcttatctctcagaagtactttccttgcacagtttctacttgtccttcacagaaaagccttgacactaataaaatatatagaagacgatacgcagaagggaaaaaagccctttaaatctcttcggaacctgaagatagaccttgatttaacagcagagggcgatcttaacataataatggctctggctgagaaaattaaaccaggcctacactcttttatctttggaagacctttctacactagtgtgcaagaacgagatgttctaatgactttttaaatgtgtaacttaataagcctattccatcacaatcatgatcgctggtaaagtagctcagtggtgtggggaaacgttcccctggatcatactccagaattctgctctcagcaattgcagttaagtaagttacactacagttctcacaagagcctgtgaggggatgtcaggtgcatcattacattgggtgtctcttttcctagatttatgcttttgggatacagacctatgtttacaatataataaatattattgctatcttttaaagatataataataggatgtaaacttgaccacaactactgtttttttgaaatacatgattcatggtttacatgtgtcaaggtgaaatctgagttggcttttacagatagttgactttctatcttttggcattctttggtgtgtagaattactgtaatacttctgcaatcaactgaaaactagagcctttaaatgatttcaattccacagaaagaaagtgagcttgaacataggatgagctttagaaagaaaattgatcaagcagatgtttaattggaattgattattagatcctactttgtggatttagtccctgggattcagtctgtagaaatgtctaatagttctctatagtccttgttcctggtgaaccacagttagggtgttttgtttattttattgttcttgctattgttgatattctatgtagttgagctctgtaaaaggaaattgtattttatgttttagtaattgttgccaactttttaaattaattttcattatttttgagccaaattgaaatgtgcacctcctgtgccttttttctccttagaaaatctaattacttggaacaagttcagatttcactggtcagtcattttcatcttgttttcttcttgctaagtcttaccatgtacctgctttggcaatcattgcaactctgagattataaaatgccttagagaatatactaactaataagatctttttttcagaaacagaaaatagttccttgagtacttccttcttgcatttctgcctatgtttttgaagttgttgctgtttgcctgcaataggctataaggaatagcaggagaaattttactgaagtgctgttttcctaggtgctactttggcagagctaagttatcttttgttttcttaatgcgtttggaccattttgctggctataaaataactgattaatataattctaacacaatgttgacattgtagttacacaaacacaaataaatattttatttaaaattctggaagtaatataaaagggaaaatatatttataagaaagggataaaggtaatagagcccttctgccccccacccaccaaatttacacaacaaaatgacatgttcgaatgtgaaaggtcataatagctttcccatcatgaatcagaaagatgtggacagcttgatgttttagacaaccactgaactagatgactgttgtactgtagctcagtcatttaaaaaatatataaatactaccttgtagtgtcccatactgtgttttttacatggtagattcttatttaagtgctaactggttattttctttggctggtttattgtactgttatacagaatgtaagttgtacagtgaaataagttattaaagcatgtgtaaacattgttatatatcttttctcctaaatggagaattttgaataaaatatatttgaaatttt

SEQ ID NO: 2572 - DNA, 4808 bp, Homo sapiens
  ENST00000488117
gcaggcggtggcgagtggatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaatgccatcagctcacacttgcaaacctgtggctgttccgttgtagtaggtagcagtgcagagaaagtaaataaggtagtttattttataatctagcaaatgatttgactctttaagactgatgatatatcatggattgtcatttaaatggtaggttgcaattaaaatgatctagtagtataaggaggcaatgtaatctcatcaaattgctaagacaccttgtggcaacagtgagtttgaaataaactgagtaagaatcatttatcagtttattttgatagctcggaaataccagtgtcagtagtgtataaatggttttgagaatatattaaaatcagatatataaaaaaaattactcttctatttcccaatgttatctttaacaaatctgaagatagtcatgtacttttggtagtagttccaaagaaatgttatttgtttattcatcttgatttcattgtcttcgctttccttctaaatctgtcccttctagggagctattgggattaagtggtcattgattattatactttattcagtaatgtttctgaccctttccttcagtgctacttgagttaattaaggattaatgaacagttacatttccaagcattagctaataaactaaaggattttgcacttttcttcactgaccattagttagaaagagttcagagataagtatgtgtatctttcaatttcagcaaacctaattttttaaaaaaagttttacataggaaatatgttggaaatgatactttacaaagatattcataatttttttttgtaatcagctactttgtatatttacatgagccttaatttatatttctcatataaccatttatgagagcttagtatacctgtgtcattatattgcatctacgaactagtgaccttattccttctgttacctcaaacaggtggctttccatctgtgatctccaaagccttaggttgcacagagtgactgccgagctgctttatgaagggagaaaggctccatagttggagtgtttttttttttttttttaaacatttttcccatcctccatcctcttgagggagaatagcttaccttttatcttgttttaatttgagaaagaagttgccaccactctaggttgaaaaccactcctttaacataataactgtggatatggtttgaatttcaagatagttacatgcctttttatttttcctaatagagctgtaggtcaaatattattagaatcagatttctaaatcccacccaatgacctgcttattttaaatcaaattcaataattaattctcttctttttggaggatctggacattctttgatatttcttacaacgaatttcatgtgtagacccactaaacagaagctataaaagttgcatggtcaaataagtctgagaaagtctgcagatgatataattcacctgaagagtcacagtatgtagccaaatgttaaaggttttgagatgccatacagtaaatttaccaagcattttctaaatttatttgaccacagaatccctattttaagcaacaactgttacatcccatggattccaggtgactaaagaatacttatttcttaggatatgttttattgataataacaattaaaatttcagatatctttcataagcaaatcagtggtctttttacttcatgttttaatgctaaaatattttcttttatagatagtcagaacattatgcctttttctgactccagcagagagaaaatgctccaggttatgtgaagcagaatcatcatttaaatatgagtcagggctctttgtacaaggcctgctaaaggattcaactggaagctttgtgctgcctttccggcaagtcatgtatgctccatatcccaccacacacatagatgtggatgtcaatactgtgaagcagatgccaccctgtcatgaacatatttataatcagcgtagatacatgagatccgagctgacagccttctggagagccacttcagaagaagacatggctcaggatacgatcatctacactgacgaaagctttactcctgatttgaatatttttcaagatgtcttacacagagacactctagtgaaagccttcctggatcaggtctttcagctgaaacctggcttatctctcagaagtactttccttgcacagtttctacttgtccttcacagaaaagccttgacactaataaaatatatagaagacgatacgcagaagggaaaaaagccctttaaatctcttcggaacctgaagatagaccttgatttaacagcagagggcgatcttaacataataatggctctggctgagaaaattaaaccaggcctacactcttttatctttggaagacctttctacactagtgtgcaagaacgagatgttctaatgactttttaaatgtgtaacttaataagcctattccatcacaatcatgatcgctggtaaagtagctcagtggtgtggggaaacgttcccctggatcatactccagaattctgctctcagcaattgcagttaagtaagttacactacagttctcacaagagcctgtgaggggatgtcaggtgcatcattacattgggtgtctcttttcctagatttatgcttttgggatacagacctatgtttacaatataataaatattattgctatcttttaaagatataataataggatgtaaacttgaccacaactactgtttttttgaaatacatgattcatggtttacatgtgtcaaggtgaaatctgagttggcttttacagatagttgactttctatcttttggcattctttggtgtgtagaattactgtaatacttctgcaatcaactgaaaactagagcctttaaatgatttcaattccacagaaagaaagtgagcttgaacataggatgagctttagaaagaaaattgatcaagcagatgtttaattggaattgattattagatcctactttgtggatttagtccctgggattcagtctgtagaaatgtctaatagttctctatagtccttgttcctggtgaaccacagttagggtgttttgtttattttattgttcttgctattgttgatattctatgtagttgagctctgtaaaaggaaattgtattttatgttttagtaattgttgccaactttttaaattaattttcattatttttgagccaaattgaaatgtgcacctcctgtgccttttttctccttagaaaatctaattacttggaacaagttcagatttcactggtcagtcattttcatcttgttttcttcttgctaagtcttaccatgtacctgctttggcaatcattgcaactctgagattataaaatgccttagagaatatactaactaataagatctttttttcagaaacagaaaatagttccttgagtacttccttcttgcatttctgcctatgtttttgaagttgttgctgtttgcctgcaataggctataaggaatagcaggagaaattttactgaagtgctgttttcctaggtgctactttggcagagctaagttatcttttgttttcttaatgcgtttggaccattttgctggctataaaataactgattaatataattctaacacaatgttgacattgtagttacacaaacacaaataaatattttatttaaaattctggaagtaatataaaagggaaaatatatttataagaaagggataaaggtaatagagcccttctgccccccacccaccaaatttacacaacaaaatgacatgttcgaatgtgaaaggtcataatagctttcccatcatgaatcagaaagatgtggacagcttgatgttttagacaaccactgaactagatgactgttgtactgtagctcagtcatttaaaaaatatataaatactaccttgtagtgtcccatactgtgttttttacatggtagattcttatttaagtgctaactggttattttctttggctggtttattgtactgttatacagaatgtaagttgtacagtgaaataagttattaaagcatgtgtaaacattgttatatatcttttctcctaaatggagaattttgaataaaatatatt

SEQ ID NO: 2573 - DNA, 1873 bp, Homo sapiens
  ENST00000379997
acgtaacctacggtgtcccgctaggaaagagaggtgcgtcaaacagcgacaagttccgcccacgtaaaagatgacgcttgatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaagtaagaatttttcttttcataaaagctggatgaagcagataccatcttatgctcacctatgacaagatttggaagaaagaaaataacagactgtctacttagattgttctagggacattacgtatttgaactgttgcttaaatttgtgttatttttcactcattatatttctatatatatttggtgttattccatttgctatttaaagaaaccgagtttccatcccagacaagaaatcatggccccttgcttgattctggtttcttgttttacttctcattaaagctaacagaatcctttcatattaagttgtactgtagatgaacttaagttatttaggcgtagaacaaaattattcatatttatactgatctttttccatccagcagtggagtttagtacttaagagtttgtgcccttaaaccagactccctggattaatgctgtgtacccgtgggcaaggtgcctgaattctctatacacctatttcctcatctgtaaaatggcaataatagtaatagtacctaatgtgtagggttgttataagcattgagtaagataaataatataaagcacttagaacagtgcctggaacataaaaacacttaataatagctcatagctaacatttcctatttacatttcttctagaaatagccagtatttgttgagtgcctacatgttagttcctttactagttgctttacatgtattatcttatattctgttttaaagtttcttcacagttacagattttcatgaaattttacttttaataaaagagaagtaaaagtataaagtattcacttttatgttcacagtcttttcctttaggctcatgatggagtatcagaggcatgagtgtgtttaacctaagagccttaatggcttgaatcagaagcactttagtcctgtatctgttcagtgtcagcctttcatacatcattttaaatcccatttgactttaagtaagtcacttaatctctctacatgtcaatttcttcagctataaaatgatggtatttcaataaataaatacattaattaaatgatattatactgactaattgggctgttttaaggc

SEQ ID NO: 2574 - DNA, 777 bp, Homo sapiens
  ENST00000379995
tctcttttgggggcggggtctagcaagagcagatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaagtaagaatttttcttttcataaaagctggatgaagc

SEQ ID NO: 2575 - DNA, 862 bp, Homo sapiens
  ENST00000461679
acgtaacctacggtgtcccgctaggaaagagaggtgcgtcaaacagcgacaagttccgcccacgtaaaagatgacgcttggtgtgtcagccgtccctgctgcccggttgcttctcttttgggggcggggtctagcaagagcaggtgtgggtttaggagatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttctt

SEQ ID NO: 2576 - DNA, 3339 bp, Homo sapiens
  ENST00000619707
acgtaacctacggtgtcccgctaggaaagagaggtgcgtcaaacagcgacaagttccgcccacgtaaaagatgacgcttggtgtgtcagccgtccctgctgcccggttgcttctcttttgggggcggggtctagcaagagcaggtgtgggtttaggagatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaatgccatcagctcacacttgcaaacctgtggctgttccgttgtagtaggtagcagtgcagagaaagtaaataagatagtcagaacattatgcctttttctgactccagcagagagaaaatgctccaggttatgtgaagcagaatcatcatttaaatatgagtcagggctctttgtacaaggcctgctaaaggattcaactggaagctttgtgctgcctttccggcaagtcatgtatgctccatatcccaccacacacatagatgtggatgtcaatactgtgaagcagatgccaccctgtcatgaacatatttataatcagcgtagatacatgagatccgagctgacagccttctggagagccacttcagaagaagacatggctcaggatacgatcatctacactgacgaaagctttactcctgatttgaatatttttcaagatgtcttacacagagacactctagtgaaagccttcctggatcaggtctttcagctgaaacctggcttatctctcagaagtactttccttgcacagtttctacttgtccttcacagaaaagccttgacactaataaaatatatagaagacgatacgcagaagggaaaaaagccctttaaatctcttcggaacctgaagatagaccttgatttaacagcagagggcgatcttaacataataatggctctggctgagaaaattaaaccaggcctacactcttttatctttggaagacctttctacactagtgtgcaagaacgagatgttctaatgactttttaaatgtgtaacttaataagcctattccatcacaatcatgatcgctggtaaagtagctcagtggtgtggggaaacgttcccctggatcatactccagaattctgctctcagcaattgcagttaagtaagttacactacagttctcacaagagcctgtgaggggatgtcaggtgcatcattacattgggtgtctcttttcctagatttatgcttttgggatacagacctatgtttacaatataataaatattattgctatcttttaaagatataataataggatgtaaacttgaccacaactactgtttttttgaaatacatgattcatggtttacatgtgtcaaggtgaaatctgagttggcttttacagatagttgactttctatcttttggcattctttggtgtgtagaattactgtaatacttctgcaatcaactgaaaactagagcctttaaatgatttcaattccacagaaagaaagtgagcttgaacataggatgagctttagaaagaaaattgatcaagcagatgtttaattggaattgattattagatcctactttgtggatttagtccctgggattcagtctgtagaaatgtctaatagttctctatagtccttgttcctggtgaaccacagttagggtgttttgtttattttattgttcttgctattgttgatattctatgtagttgagctctgtaaaaggaaattgtattttatgttttagtaattgttgccaactttttaaattaattttcattatttttgagccaaattgaaatgtgcacctcctgtgccttttttctccttagaaaatctaattacttggaacaagttcagatttcactggtcagtcattttcatcttgttttcttcttgctaagtcttaccatgtacctgctttggcaatcattgcaactctgagattataaaatgccttagagaatatactaactaataagatctttttttcagaaacagaaaatagttccttgagtacttccttcttgcatttctgcctatgtttttgaagttgttgctgtttgcctgcaataggctataaggaatagcaggagaaattttactgaagtgctgttttcctaggtgctactttggcagagctaagttatcttttgttttcttaatgcgtttggaccattttgctggctataaaataactgattaatataattctaacacaatgttgacattgtagttacacaaacacaaataaatattttatttaaaattctggaagtaatataaaagggaaaatatatttataagaaagggataaaggtaatagagcccttctgccccccacccaccaaatttacacaacaaaatgacatgttcgaatgtgaaaggtcataatagctttcccatcatgaatcagaaagatgtggacagcttgatgttttagacaaccactgaactagatgactgttgtactgtagctcagtcatttaaaaaatatataaatactaccttgtagtgtcccatactgtgttttttacatggtagattcttatttaagtgctaactggttattttctttggctggtttattgtactgttatacagaatgtaagttgtacagtgaaataagttattaaagcatgtgtaaacattgttatatatcttttctcctaaatggagaattttgaataaaatatatttgaaattttg

SEQ ID NO: 2577 - DNA, 1555 bp, Homo sapiens
  ENST00000338437
ccgctgctttaagaggctgctccgcggtagcgagcggggccggagccgcagcccgaacgagcggaccgagccgaccgggcaggtgcacggctgcggggacggcagcggcatgaccggccaccacggctggggctacggccaggacgacggcccctcgcattggcacaagctgtatcccattgcccagggagatcgccaatcacccatcaatatcatctccagccaggctgtgtactctcccagcctgcaaccactggagctttcctatgaggcctgcatgtccctcagcatcaccaacaatggccactctgtccaggtagacttcaatgacagcgatgaccgaaccgtggtgactgggggccccctggaagggccctaccgcctcaagcagtttcacttccactggggcaagaagcacgatgtgggttctgagcacacggtggacggcaagtccttccccagcgagctgcatctggttcactggaatgccaagaagtacagcacttttggggaggcggcctcagcacctgatggcctggctgtggttggtgtttttttggagacaggagacgagcaccccagcatgaatcgtctgacagatgcgctctacatggtccggttcaagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcagatggggaagttccggagcctgctttttacctcggaggacgatgagaggatccacatggtgaacaacttccggccaccacagccactgaagggccgcgtggtaaaggcctccttccgggcctgagctgcccatctgcctagccggccactagggcaccatcttctcaagggcttccatgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtccaagcctggggctgcctctgctctccaagacccaaagaccctgggaacctcctctggtcttccccactggcagtggcagcagccccaccccgagcgcacactgtgatggaggagactgagctccctggggcgggcagctgacactaccagagagactcaagcaataattagaggtgggcagagctgccctctcggcattacctcttctgcaggctctgccatgcacgcacctcactgccaggccattaaaatcagcacccagcatgctggaggtgacgtggccttctccctccagccacctgctgccacgggcaggccctggctatagcttatacagtatctccccttgtccccacccagtcaccaaagccacctacatgacagtccatccctgttgaattaataaattaatgtatccatgcaacaaata

SEQ ID NO: 2578 - DNA, 1161 bp, Homo sapiens
  ENST00000548332
cggcaagtgagcggggacctcgggggagcggggctccgcgtggcaagggcgcagtgtcccccggagagaatttccccgcagaagtggccgagctgccttctcggccggtacgtgagggaagggggcacttgggggcgcaagcatgtgtctgggtgtctacaccgagcagggtgtttgcgcacgtccgggtgtgagtcgtgggagcccgtggcccacaccagcctcctgggctgacgcggaagagagctccttcatcctgcctcagtttccttaggactcagagaaagggagaagaggcagaaggcccctcgcattggcacaagctgtatcccattgcccagggagatcgccaatcacccatcaatatcatctccagccaggctgtgtactctcccagcctgcaaccactggagctttcctatgaggcctgcatgtccctcagcatcaccaacaatggccactctgtccaggtagacttcaatgacagcgatgaccgaaccgctgcatctggttcactggaatgccaagaagtacagcacttttggggaggcggcctcagcacctgatggcctggctgtggttggtgtttttttggagacaggagacgagcaccccagcatgaatcgtctgacagatgcgctctacatggtccggttcaagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcagatggggaagttccggagcctgctttttacctcggaggacgatgagaggatccacatggtgaacaacttccggccaccacagccactgaagggccgcgtggtaaaggcctccttccgggcctgagctgcccatctgcctagccggccactagggcaccatcttctcaagggcttccatgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtcc

SEQ ID NO: 2579 - DNA, 1713 bp, Homo sapiens
  ENST00000394069
cggcaagtgagcggggacctcgggggagcggggctccgcgtggcaagggcgcagtgtcccccggagagaatttccccgcagaagtggccgagctgccttctcggccggtacgtgagggaagggggcacttgggggcgcaagcatgtgtctgggtgtctacaccgagcagggtgtttgcgcacgtccgggtgtgagtcgtgggagcccgtggcccacaccagcctcctgggctgacgcggaagagagctccttcatcctgcctcagtttccttaggactcagagaaagggagaagaggcagaaggcccctcgcattggcacaagctgtatcccattgcccagggagatcgccaatcacccatcaatatcatctccagccaggctgtgtactctcccagcctgcaaccactggagctttcctatgaggcctgcatgtccctcagcatcaccaacaatggccactctgtccaggtagacttcaatgacagcgatgaccgaaccgtggtgactgggggccccctggaagggccctaccgcctcaagcagtttcacttccactggggcaagaagcacgatgtgggttctgagcacacggtggacggcaagtccttccccagcgagctgcatctggttcactggaatgccaagaagtacagcacttttggggaggcggcctcagcacctgatggcctggctgtggttggtgtttttttggagacaggagacgagcaccccagcatgaatcgtctgacagatgcgctctacatggtccggttcaagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcagatggggaagttccggagcctgctttttacctcggaggacgatgagaggatccacatggtgaacaacttccggccaccacagccactgaagggccgcgtggtaaaggcctccttccgggcctgagctgcccatctgcctagccggccactagggcaccatcttctcaagggcttccatgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtccaagcctggggctgcctctgctctccaagacccaaagaccctgggaacctcctctggtcttccccactggcagtggcagcagccccaccccgagcgcacactgtgatggaggagactgagctccctggggcgggcagctgacactaccagagagactcaagcaataattagaggtgggcagagctgccctctcggcattacctcttctgcaggctctgccatgcacgcacctcactgccaggccattaaaatcagcacccagcatgctggaggtgacgtggccttctccctccagccacctgctgccacgggcaggccctggctatagcttatacagtatctccccttgtccccacccagtcaccaaagccacctacatgacagtccatccctgttgaattaataaattaatgtatccatgcaacaaataccaa

SEQ ID NO: 2580 - DNA, 1555 bp, Homo sapiens; identical to SEQ ID NO: 2577
  ENST00000338437

SEQ ID NO: 2581 - DNA, 1161 bp, Homo sapiens; identical to SEQ ID NO: 2578
  ENST00000548332

SEQ ID NO: 2582 - DNA, 1713 bp, Homo sapiens; identical to SEQ ID NO: 2579
  ENST00000394069

SEQ ID NO: 2583 - DNA, 3676 bp, Homo sapiens
  ENST00000355854
gtgacgttacaggactgaggagggaggaagtaaaagggagctgtgactgtggtacgtatctgaaagcaagtgttagagagggagtggagaacgcataagcaagctggtttgaccagaaacagaactgcctgtgacagattaagagacaagcaaggcttggaatctgagagcaagcaaagagagtggaaatttacagctgccctatgtgagtgttcaagtgatcattttctggtaacgttttccagtggtaactgttactcttcaaaaagagggacagaaagtcaagacctaattgtggaaactcttttctctgccacgcttggtaataggaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgtatcagatgttgataaaagcaatttttttctaataagctgtcattctataattgcccatcacagtctttagtgaacacatagaaagcctatacagttttggtcctgaatagtctcttgtgactaggatgattgaggtgttaattcctcttccttataaaaaggcttggaatcaaaaatattttaaaaggccgtggtttcgtttcagacatcaaccatctaaaacgggattttaaagcgatattttacaagaatgaaaggcacaattgttgatctgtattttttacacttcagtttctaaatcatgaatcgttgccttccacaggaaccctcccttatacattacttgagtgttgtgtagtttttcttcagccaggtatttctctgcctagagaggggaagagaaatgtgttctccaggactgatcccctttgtagattttgtacctgaagagttacctggcagggcaccacccttggctaggcccaggtgtgtgtttctttcttgcctggcatggaccccgaggcaggtgatgtggggcctggcgcacctccccgctttggcagctgtggcctccctggccagtgcccttgcaggaggccggccggcagcctgatgacccgtactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtaccacaca

SEQ ID NO: 2584 - DNA, 2416 bp, Homo sapiens
  ENST00000409308
ccgcagtggcgcccgagcgcgccgcctcccgattgactgctagcgctctcggcttgtctcgcgcactgtagctgagccaatggagttactcgtagtcgagaggccggcatcactggagtggtggcgcagctgtttcctccggatatccatcaaatattgagaagaaagaatatcaggagcaaagtgttctaagttgctgttcagaacgtaaagatgcgaaccccaaatcagtggtttgttcattcttcatgcaagagcaatgcactaaaggagagaagcaagctgtggtgatcagtgactttggtgaaagctaagaaggttcaaacaaatttgcaaatgatatacaacttctaagcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgta

SEQ ID NO: 2585 - DNA, 1411 bp, Homo sapiens
  ENST00000409130
gagtatatctaagtgtttcagaatacactcaaattccagaatacgtctgcaatagtgccaggcacatagtagatcttcagtggatattgaatgaatcgtgacaaatgatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacg

SEQ ID NO: 2586 - DNA, 1035 bp, Homo sapiens
  ENST00000425242
gcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaagatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtc

SEQ ID NO: 2587 - DNA, 1627 bp, Homo sapiens
  ENST00000410043
gagccaatggagttactcgtagtcgagaggccggcatcactggagtggtggcgcagctgtttcctccggatatccatcaaatattgagaagaaagaatatcaggagcaaagtgttctaagttgctgttcagaacgtaaagatgcgaaccccaaatcagtggtttgttcattcttcatgcaagagcaatgcactaaaggagagaagcaagctgtggtgatcagtgactttggtgaaagctaagaaggttcaaacaaatttgcaaatgatatacaacttctaaggaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaa

SEQ ID NO: 2588 - DNA, 727 bp, Homo sapiens
  ENST00000457041
agagagggagtggagaacgcataagcaagctggtttgaccagaaacagaactgcctgtgacagattaagagacaagcaaggcttggaatctgagagcaagcaaagagagtggaaatttacagctgccctatcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaagg

SEQ ID NO: 2589 - DNA, 633 bp, Homo sapiens
  ENST00000413278
agcgttttgttagggaagaagtggagaacagatattggaaggcaattagctgtctctaatacattgataaaatatataactataactgcaaaatgctaataacccagcagaggagtagatttgggaacataagatgaaaaagtcaacaagtgcattgatcacaacatatggtaatgatagcgtgattgtgatgacctttgttttatacctccttttacattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgc

SEQ ID NO: 2590 - DNA, 468 bp, Homo sapiens
  ENST00000409082
ggatttcttgtagaagccagttaaaaggagaacctagtatcacactaggcttctgaaaacaccaatcaagagttgcttaatgcaggggtcccttacccctgggctgcagacctgtacctgtccatggcctgttaggaaccgggcagcacagtaggagcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgaggtaa

SEQ ID NO: 2591 - DNA, 895 bp, Homo sapiens
  ENST00000476943
agaacctagtatcacactaggcttctgaaaacaccaatcaagagttgcttaatgcaggggtcccttacccctgggctgcagacctgtacctgtccatggcctgttaggaaccgggcagcacagtaggaggactgaggagggaggaagtaaaagggagctgtgactgtggtacgtatctgaaagcaagtgttagagagggagtggagaacgcataagcaagctggtttgaccagaaacagaactgcctgtgacagattaagagacaagcaaggcttggaatctgagagcaagcaaagagagtggaaatttacagctgccctatgaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggtaagagctaaaacagtaacattatgattaaagtacatgcatcgcaatgccaaaaaccaatgtaaaagcttaatgaagaattcaaaatatggtctgtgatgtgcacatagaccctctataaatagatttaagttgatttcaggttttatgcaactgattattatttagtctgttgtgatgaactttaggttcactctctagagactctgaccacaccggatccctctagactacacagcttaaagatctaaaaggttatactggtgtgtaatgttacatttacatgaaaggta

SEQ ID NO: 2592 - DNA, 581 bp, Homo sapiens
  ENST00000470410
gcactgtagctgagccaatggagttactcgtagtcgagaggccggcatcactggagtggtggcgcagctgtttcctccggatatccatcaaatattgagaagaaagaatatcaggagcaaagtgttctaagttgctgttcagaacgtaaagatgcgaaccccaaatcagtggtttgttcattcttcatgcaagagcaatgcactaaaggagagaagcaagctgtggtgatcagtgactttggtgaaagctaagaaggttcaaacaaatttgcaaatgatatacaacttctaaggcaaatctttcatctgcagttttgactctatcccaatggagaaattgttaatcttttagtaagcattaagaattgtatagaaaatgcagaatttgtttggaagaaaagcatggataattcatttgtgatgaatgttgactccacaaagggtttgttcaagtatttggagacggttgttaaattgccttttaaggaggactgaggagggaggaagtaaaagggagctgtgactgtggtacgtatctgaaagcaagtgttagagagggagtggagaacgcataagcaagc

SEQ ID NO: 2593 - DNA, 3692 bp, Homo sapiens
  ENST00000610540
ggatttcttgtagaagccagttaaaaggagaacctagtatcacactaggcttctgaaaacaccaatcaagagttgcttaatgcaggggtcccttacccctgggctgcagacctgtacctgtccatggcctgttaggaaccgggcagcacagtaggaggactgaggagggaggaagtaaaagggagctgtgactgtggtacgtatctgaaagcaagtgttagagagggagtggagaacgcataagcaagctggtttgaccagaaacagaactgcctgtgacagattaagagacaagcaaggcttggaatctgagagcaagcaaagagagtggaaatttacagctgccctatgaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgtatcagatgttgataaaagcaatttttttctaataagctgtcattctataattgcccatcacagtctttagtgaacacatagaaagcctatacagttttggtcctgaatagtctcttgtgactaggatgattgaggtgttaattcctcttccttataaaaaggcttggaatcaaaaatattttaaaaggccgtggtttcgtttcagacatcaaccatctaaaacgggattttaaagcgatattttacaagaatgaaaggcacaattgttgatctgtattttttacacttcagtttctaaatcatgaatcgttgccttccacaggaaccctcccttatacattacttgagtgttgtgtagtttttcttcagccaggtatttctctgcctagagaggggaagagaaatgtgttctccaggactgatcccctttgtagattttgtacctgaagagttacctggcagggcaccacccttggctaggcccaggtgtgtgtttctttcttgcctggcatggaccccgaggcaggtgatgtggggcctggcgcacctccccgctttggcagctgtggcctccctggccagtgcccttgcaggaggccggccggcagcctgatgacccgtactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtacc

SEQ ID NO: 2594 - DNA, 3361 bp, Homo sapiens
  ENST00000347776
ggatttcttgtagaagccagttaaaaggagaacctagtatcacactaggcttctgaaaacaccaatcaagagttgcttaatgcaggggtcccttacccctgggctgcagacctgtacctgtccatggcctgttaggaaccgggcagcacagtaggagcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgtatcagatgttgataaaagcaatttttttctaataagctgtcattctataattgcccatcacagtctttagtgaacacatagaaagcctatacagttttggtcctgaatagtctcttgtgactaggatgattgaggtgttaattcctcttccttataaaaaggcttggaatcaaaaatattttaaaaggccgtggtttcgtttcagacatcaaccatctaaaacgggattttaaagcgatattttacaagaatgaaaggcacaattgttgatctgtattttttacacttcagtttctaaatcatgaatcgttgccttccacaggaaccctcccttatacattacttgagtgttgtgtagtttttcttcagccaggtatttctctgcctagagaggggaagagaaatgtgttctccaggactgatcccctttgtagattttgtacctgaagagttacctggcagggcaccacccttggctaggcccaggtgtgtgtttctttcttgcctggcatggaccccgaggcaggtgatgtggggcctggcgcacctccccgctttggcagctgtggcctccctggccagtgcccttgcaggaggccggccggcagcctgatgacccgtactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtacc

SEQ ID NO: 2595 - DNA, 1321 bp, Homo sapiens
  ENST00000454754
gtagccgtctgcagggccccagctaagcagcccgcggagagcgagcggcgcgtgcgcccccgctgattggctggcacaaccggcaccggagccaatgggagcacgccttgttgtcaggcgcgcagccggacggcgcggtggtcgggacagactggccgttgctgtggagacgcctggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgc

SEQ ID NO: 2596 - DNA, 7222 bp, Homo sapiens
  ENST00000263119
agccggacggcgcggtggtcgggacagactggccgttgctgtggagacgcctggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 2597 - DNA, 6952 bp, Homo sapiens
  ENST00000405822
cgttgctgtggagacgcctggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccagaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 2598 - DNA, 1472 bp, Homo sapiens
  ENST00000445422
ggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaa

SEQ ID NO: 2599 - DNA, 7480 bp, Homo sapiens
  ENST00000398319
ctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 2600 - DNA, 426 bp, Homo sapiens
  ENST00000474981
tgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggtactgtgtattttttctgattgtcagaaacaaacccacaaagctccagcatacaccatcagtaacatttctcattccattgccaccctcttctctggtctcctcctctgtgttcccataacatctgtgcagatgtctgaagcacaaatctcactggagtaggat

SEQ ID NO: 2601 - DNA, 561 bp, Homo sapiens
  ENST00000484593
tcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtaacccctggctccttctcaccctgccctgccccagcaggtatgtctctgtgacatcctgcttcttcagtagttcatagctttcattgctaattaggcacccaaaggggacatgatggcttctttggttggaactttcgg

SEQ ID NO: 2602 - DNA, 557 bp, Homo sapiens
  ENST00000496016
gagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgacaccatgctggcccagggcggggaagcagggcaggggcaggctggtttctttatctccctgggcatgtggctcaaggttccagtgaccgtccttcaacctgccgcaaacttatctgtgttgagcagcttcatgtgcaattgaattaaaacatcatttcctctcttt

SEQ ID NO: 2603 - DNA, 593 bp, Homo sapiens
  ENST00000467937
atccccaccttacacagccactccgattgaccacgattacgtcaaatgtaaaaaaccccaccagcaggcaacgccggacggtacagtccctgttctccctactgccagcccagggcggcacatcaatcacgggggggtgctcggacgactcattttgtcgcttcgttttgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcg

SEQ ID NO: 2604 - DNA, 2422 bp, Homo sapiens
  ENST00000337989
actttgcccggcagcggtccacagcccgccaccagcggccagtccagggaaccggagaggattggccggcaaaagtcagttgcgctcctgggcccgcttccagtagagtgccggcgccccgtccggccgcgcctgccccgccccggcccgccgcgagcgagagagcgaacgagcctccgcggccatggcccggcgctcgccctagctccactgcacagatgccacggcggagccggcggggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagt

SEQ ID NO: 2605 - DNA, 361 bp, Homo sapiens
  ENST00000495121
ggaaggcgccgacgaggagctgtgccgtgccgctcttggggatggggcacttgatttcctgaagagcctttgcctgtgccctagaagtggaggaagctctagaaggagtcatgactgaaagaagcccagctccacctggtgtaggcagaaagccagttggcttgctaccaccctgctggctcgtgactctgcctggtggcttcactcttcagaccagctttctctggaggccagcctcatggccataggaagtcccctcaccgttcgggagggcatctggcggatccccgtggacgagattgaccggccgggcagctttgcctggcacatgaaccgctccatcgtgctgctgctcaaggtg

SEQ ID NO: 2606 - DNA, 771 bp, Homo sapiens
  ENST00000485008
ccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccaggccctcccctgcttctccctccctgcctcaaggacccagcctgtttccttgccgcagaccctgcactggcccacagcctgtgtcacccctggaggctcacctgtcttcccagttgaatttcctacccatctgaaaaacgagacagccactctgcagaagtgcccagcagaaggcaggcctaagagcccccacagactgtgcgcctgagtggaggttgagttgagaagtcttcctcagctctttcccacggtggctcaagcagcaagcaggtgctgatgttttcacctgatgccatccacactgctttgaggattgtgaacat

SEQ ID NO: 2607 - DNA, 532 bp, Homo sapiens
  ENST00000459824
ccatcccctctcactgccttgtgatgggatcttaagagaggctgggcctcgaagactcaggtgtggccccactgggtcaggtgtatagccctctcgggaggcggaggagccctctgggggtggggagccagcccctaccagtgtcctcttgggtggtgagtggtttcttggcagcaccaacctggactgcctcagccaggaccccagcattggccacactcccctgcccagtgtcccagggcacaacctgggcccataggacctgacacagatgcgttggagcctgcggggtggatgagtctattacctgcagtgagcccatgtccccacagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggg

SEQ ID NO: 2608 - DNA, 7072 bp, Homo sapiens
  ENST00000617531
agccggacggcgcggtggtcgggacagactggccgttgctgtggagacgcctggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 2609 - DNA, 176 bp, Homo sapiens
  ENST00000629653
gtagccgtctgcagggccccagctaagcagcccgcggagagcgagcggcgcgtgcgcccccgctgattggctggcacaaccggcaccggagccaatgggagcacgccttgttgtcaggcgcgcagccggacggcgcggtggtcgggacagactggccgttgctgtggagacgcctg

SEQ ID NO: 2610 - DNA, 53 bp, Homo sapiens
  ENST00000626356
agccggacggcgcggtggtcgggacagactggccgttgctgtggagacgcctg

SEQ ID NO: 2611 - DNA, 20 bp, Homo sapiens
  ENST00000626232
cgttgctgtggagacgcctg

SEQ ID NO: 2612 - DNA, 313 bp, Homo sapiens
  ENST00000627229
ggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgag

SEQ ID NO: 2613 - DNA, 311 bp, Homo sapiens
  ENST00000630829
ctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgag

SEQ ID NO: 2614 - DNA, 3824 bp, Homo sapiens
  ENST00000372348
tgtgagaattgaaatgactagcattattgacccttttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacatgaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtag

SEQ ID NO: 2615 - DNA, 532 bp, Homo sapiens
  ENST00000393293
tttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacatgcccttcagcggccagtagcatctgactttgagcctcagggtctgagtgaagccgct

SEQ ID NO: 2616 - DNA, 5766 bp, Homo sapiens
  ENST00000318560
ggccttccccctgcgaggatcgccattggcccgggttggctttggaaagcggcggtggctttgggccgggctcggcctcgggaacgccaggggcccctgggtgcggacgggcgcggccaggagggggttaaggcgcaggcggcggcggggcgggggcgggcctggcgggcgccctctccgggccctttgttaacaggcgcgtcccggccaggcggagacgcggccgcggccatgggcgggcgcgggcgcgcggggcggcggtgagggcggctggcggggccgggggcgccgggggggcgcgcgggccgagccgggcctgagccgggcccgcggaccgagctgggagaggggttccggcccccgacgtgctggcgcgggaaaatgttggagatctgcctgaagctggtgggctgcaaatccaagaaggggctgtcctcgtcctccagctgttatctggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 2617 - DNA, 1544 bp, Homo sapiens
  ENST00000400473
gtgcttatgagataaacgacagggtaactgtccacattggtcccagtttatgagggagaagagatcataatctacaaaaatttgcaaggtgaccaggggaaaagagtacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatac

SEQ ID NO: 2618 - DNA, 2074 bp, Homo sapiens
  ENST00000579963
gtgcttatgagataaacgacagggtaactgtccacattggtcccagtttatgagggagaagagatcataatctacaaaaatttgcaagacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatcgctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtat

SEQ ID NO: 2619 - DNA, 343 bp, Homo sapiens
  ENST00000580153
acctataaatacggacacccggccccggagcccgcgagccagcggccaggcgaccggcgggcggccagccagcgagccgaactagccgagctaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcag

SEQ ID NO: 2620 - DNA, 5002 bp, Homo sapiens
  ENST00000256925
atggcggcggcggcggcggccgccaccacggccgcctgcagcagcggcagcgccggcaccgacgccgcgggcgccagcggattgcagcagccgccgccgcagccccagcctcagcccgcggccgccgcgccggcccagccgccgcccgaacccccccggaagccgcgcatggacccgcggcgccgccaggctgccctctccttcctcaccaacatctcgctggacggccggctgccgccgcaggacgcggagtggggcggtggcgaggagggcggcgcggccaagccgggcgccggcggcgcctgcggcgcgaggactcggttcagcttgctcgccgctgccgagcggggcggctgcatcgcgctcgccgcgccgggcacgccggctgcggggttagccgctgggtccggcccctgcctcccacagccctcgtcgctgccgcccttgattcctggcggccatgcgaccgtgtccggccccggggtggcgcgggggttcgcgagtcccctgggcgccggccgggcgtcgggggagcagtggcagccgccccggccggcgcctctcgccgcctgtgcccaactgcagctgctcgacgggtccggggccgccgggcaggaggagttggaggaggacgatgcctttatcagcgtgcaggtgccggcggccgcctttttgggctccgggacccccgggagtgggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatcgctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtatacctgtatgcgtttgtgtagacgtgtgtctcaccagtcacctttgccctgcattgctgatccccttgcgcacactgattctagtgaggtcacagattcggagcttcacacaccagcccagagaaagggcgatggaaccgaaccgagggtctgcagctttcgttagcagagctgtcagattcttgacagtcttggaggatggagaaattcaagcagcagctggtgagggccaaaacagaatacttggcttcttcagaatcttagattgcactgagtttagtcctaaatattttgctaacaaatttccttggccagaatcagttgtaagacagtgatttgggtggtggggggagggaggagggagaggatatgattaatgtggtctctttggctgatcgaaagctagatcaactggtacttagggcacttgctgtttataaagcaaaattgagaaaatattcaaggtgcctccatcgcctgaactacaaaatgcccttggccttcctcacatggggtctgtcaccttgcatctctgataagccatccaccttcctggtcagtgcctacagggggagagcctttctgagaagcaggtcctgtggtatctgagaatggtctagagagctccccactgcccatctgcccccgaatttcctgccaagctctggggagtggggtggggggagggacgtccgatggatgacaggccgccagcccagacgtggggagagaagcctgagtcctttcctgtgtgataaaatcaggctaatttacttggatttggggtgatttgtttggtttttagcatttatgaggtgagcccatgaagttagtggtccattactttttaaagatgcattttcattttaaactgtctcctggcctgtggatttgtggaatggacagttttgtgggttttaatttatttgtgaggagtcggggctgagaaggcattttatcaggaggtctccttttgcacgtccatgacatgagcttttcggaggcaaaggaagtggaggagggtgagagatgcaggtcactgccagaggcacctctgtgacacggaacattccagacacgtcgcagccttgggcttcggcgaggaggaagtctgagcctgtgaagcgagaaggccaggcagtagactggctctgaggttttgccctttgacctcctccacagagggcagcttcagccccttgtaagccctgccccctctcaggactgccctgaggcctctccagtcctccccacactcagagatctgtggggaagctccgcccagccacactccttgggataatactagccggttctgcctgattccttttcccccggagccagcctagggggcccgggactcctctagtgagccttgactgttaggtaagagacaggaagcagacaagccaagaggttgctgcagctgcccccaggaggaaacgggcagcagggagtgtggcccagcccccactgtacccctccaggggcccgagcccttgccagcccaatgacaccttgaagtcaccacttttcctttcttgcccgctaataaaacctatttaaacaggaaattcataccaaatgcaaatgggttttgttttccttggcattttgttgttccgatcacagatttccctgccagggtgtctgtggttatcagctgcaggctcagcttggggcggccgcttcacacaagccactctgtaccacgtgccctaccttagtgacgggagtaaggagcttccttcccctccatgtcattccttcctgttcccttcattccccaacagcaaataaaactgttgaatgct

SEQ ID NO: 2621 - DNA, 604 bp, Homo sapiens
  ENST00000582882
cggccgcctttttgggctccgggacccccgggagtgggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcgggtatgtatatgcatgcatgctttgtagttctctgggtgaaaagatctcacaccaatgtacataatgtggccatcctttccattttcaagaagttgccttgctttgatactgcaaattcagtatttgtacactggaatgataaaaagatgttccactttcttttcagccagaaagctt

SEQ ID NO: 2622 - DNA, 519 bp, Homo sapiens
  ENST00000583220
gggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagctcctgagtctccttgggacccctgatgagcacagcccaggctctcagtctgcgggccagatccacggctgatttgctcttctgaccctgaaaacgctggcatggaggctcccgcgtccccagacctgctgaccgtgtgatagaggccccagtattgaggaggatttggacttctcatctcagcaaggaccagagtgcagctcaa

SEQ ID NO: 2623 - DNA, 413 bp, Homo sapiens
  ENST00000580644
ctcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggaggaaaatccatgaataacgttgagaagcccctggagtttcgagaggctactagaagccatggtccttggaacaacgtggccactgtgagccgaaggaaaccgggtgactcggggtaccggctacagagggctctcccctcttcaggaattcccaggcagggctgttgagcctcgggatgcagtgtccttgagtctcgaggtgtcgaggagaggctggaggaggacgt

SEQ ID NO: 2624 - DNA, 579 bp, Homo sapiens
  ENST00000578052
ctggagcagccaggccagggcggcagcaccagcgccttcgagcagctgcagaggtcccgacggcgcctcatctcccagagatcttccttggagaccctggaagatattgaggagaacgcccctctccggaggtaattttctgtttcatttatgtatatgtaaacagtacaccatgacagccagagattgattttggttttttaacttcttgatctatagaattaaatttaaaaataaccatctgaactccagggactatgggacatctcctagtgtctaacccacctctgaagaccactagaactaaacaacgttaaatccaattaggtgttggagtagcccaatttgcatggagatttgggtgcttttctttccgtggcgcctcttcattttgtaaactgctgcttaatggaacaagagcccagcattgtcccggcctatcccccaggtgcagtcacacagtaggtacagtcctggacttcattctcagcaggaggggcaacaagaactcctcaggaggtaaccacgatgtcgctccctggctaggtgctgggaagcccaattaggatagttgtgagt

SEQ ID NO: 2625 - DNA, 584 bp, Homo sapiens
  ENST00000585061
agaaacacgatccccaggcccagcctcagacccactgggtcagaagctctggggcggggcccagcaatctatttcaacaaggccccaacttgcgcctgtcgcccgttcaggcttgggagcagccactgtggacaaagccttgtgtacctccagctttactggaccttctggaagatgtgaacagtgtctagtgctccagaaaagattttatttattctagcacaaatggacagaagttatcgctgatgtgggggctctgctatccagacggcgcctcatctcccagagatcttccttggagaccctggaagatattgaggagaacgcccctctccggagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtca

SEQ ID NO: 2626 - DNA, 2471 bp, Homo sapiens
  ENST00000420687
ggccatttttcttcctggtgtttgaatgactcataaaatgagtttggagtggtctgaagcctctgcctccttccttgaatgctttctaagaggggctgccatgcaagaatatatgctgattttcccatacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatcgctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgta

SEQ ID NO: 2627 - DNA, 1658 bp, Homo sapiens
  ENST00000316803
gggcggggcgcggcggtacctgggccgccagggagccgggggtgggctctccggggacagccggcagcgcccccagatctgcaccgccagccgccgggagctccgggctccgggcgtagaggctgcgctgtcacatgggcggcggcgacggggccgcatttaagcggccgggggacggcgcccgcctccagcgcgtcctcgggcttggctcccgccgggagccccgttctctgcccgccgggggccccgcgccgcgccgcaccgcgccgcccccgccgggccatgcgagcgcgggccccgccgcgatgagctcgcacatcgccaaaagcgagtccaagacgtcgctgctgaaggcggcggcggcggcggcgagcgggggcagccgggctccccgccacggccctgcccgggacccggggctgcctagccgccggctacccggctcctgcccggcgacgccgcagtcgtccggggaccccagttcgcggaggcccctgtgccggccggcgccgcgagaggagggcgcgcgggggagccagcgtgtgctcccccaggcgcactgcaggccccgggaggcgctgccggccgcggcgtcccgaccttcgccgtcgtcgccgctgccgccggcccgcgggcgggatggggaggaacggggactgtccccggcgctcggcctccggggctctctgcgagcccggggccgcggggactccgttccagccgccgcgtccgaggcggacccgttcctccaccggctgcgccccatgctcagctccgcctttggccaggatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaata

SEQ ID NO: 2628 - DNA, 1369 bp, Homo sapiens
  ENST00000288616
cggcaggcaccctggcttcgggaacccaaactagccagcttccctttctgggcctgctggcctaattcccagccgcagctgccattctgggcccccctccctgaggccatctccctgcagatttggcagcggggaaaggaggggccgagagaaggggagagaaccagagacaggactgagcgctaatctgatgtagatgatccggcagccttctccagcttggttcccctctgccatcagctctccaggtgactttccctgtgccctgcactctccccttctgctttcatctccttaagaaagtgcccagaaagttaaacccacacacaaacacacacacaatccacccaaaaaaaaaaaaaatcggagagcaggagcaggcagacgagtaagagagcacgcgcgcaagagagggctcacatccgtcctggaggaagaacggcacagacggagggaggctggggttggcagagactgggacggaagtccctcagtcccccaggagcctccttcatggacccggggatcccaagaggggctgcctcaacttaggatgggcaactgtgtcaagtatccactgagaaatctctcaaggaagatgtgccaggaggaacagaccagctacatggtggtgcagacgagcgaggaggggctggcggctgacgccgagctcccgggaccgctcctgatgctggcccagaactgcgcagtcatgcacaacctgctgggccctgcctgcattttcctgcgcaagggcttcgctgagaacaggcagcctgatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccgggg

SEQ ID NO: 2629 - DNA, 770 bp, Homo sapiens
  ENST00000351200
ccgtcctggaggaagaacggcacagacggagggaggctggggttggcagagactgggacggaagtccctcagtcccccaggagcctccttcatggacccggggatcccaagaggggctgcctcaacttaggatgggcaactgtgtcaagtatccactgagaaatctctcaaggaaggatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggagg

SEQ ID NO: 2630 - DNA, 1857 bp, Homo sapiens
  ENST00000453000
ggtgggtgcctgtaaaccaagctactcaggaggctgaggcaggagaatcacttgaatccgggagtcagaggttgcagtgagccaagatcacgccactgcactccagcctgggcgacagagtgcactagccacacacgaaaaaggagggggcatgtttccactttgccccagtccccacctctcacaccctgcctgcttcatttatgtcagcaatggcacctgcatgtgcaacctctggtctggcagaccagccaagcctggtctccatgctgccagctccgattgccctcactgccttccagcggggatctggctggagtaggacaagtctgtttgggagctgggaggaatgacttagccctggagattgactgaattgggaggttgggagcattttgggaaaggatgttgtctcattaggctctgagtgaacacttcccattggtgagaatagaagccccccgctgcccctgtctcttcatgcacttgggtgtgtgattctgtgcatatgtatgtgccagtgcgtgcgtgcgtgtgtgtgtgtgtgtgtgtgcgcatgtgccacacagagggcatcacattcagctctccccggaaccaccatttccgtcaaggattggagactctgtctgttggaccaatttgatgcctgtgcacgctcagggctctctgaaccccgctccttgactctcagggtcccctcttgcggaaagcccctcccgggaccaggagccaggctgggcagggaggtgacaccctgcctctcttttgcatttgcttggtgctggctgaagatgtgccaggaggaacagaccagctacatggtggtgcagacgagcgaggaggggctggcggctgacgccgagctcccgggaccgctcctgatgctggcccagaactgcgcagtcatgcacaacctgctgggccctgcctgcattttcctgcgcaagggcttcgctgagaacaggcagcctgatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaa

SEQ ID NO: 2631 - DNA, 3048 bp, Homo sapiens
  ENST00000498082
caactggcagctcaccaacctgagcttcctccaggcctgctccttggagatgtctctgccatctgttctgacgcctagattcagggttgccttgattgcccaggagacctgggcactgcttgaggctggagacatgtgctttttggaccctggctccagccagaagcactggtggcccccggggtcctatgtggtgtcctgtgatcccatgacaggggaacgtacagggatgggggtcaaattggagaaggtggggcagtgcccgcgaagcagtcacagccccattctgttgccacgtctcctcctgactcctccctgtcctcctaccctcgcttcaggatggccctgccttccctcccctcctgcgcctcttctgttgtcttgcagcctctgtcgccctgctcttcctgtttcattgggtggtgctctcttttccctgttgtgacctccctggactctgttttatttgcaggtttttgccaccaggcaagctctgttctctgactcattctttttttgttttttttttttgagacagggtctcactctgttgtccagggtgacagagtgcaatggcaccatcatagctcactacagcctcaaactcctgctgacccattcttgtatctggaacaaggggctggaggcacagaggttctgtgcccaggctggtggggctggtggcttcttgggcatctcctgttaggggcccaggagcttctatgtctaagggagatgtggggctttcttctcccctcaaggacctgatccaggcacacctgtgctgcatcctcgtcacctcctacccagtgcctgctgccacgtggatggcccccaggttaggtattttgtgacttccaggtcccttgtcgcggctaataggacatgttcttttgtttcaggatagatcactgcgaccagaggaaattgaaggtaaaacttggccccttgggggaaaggactgcctagccctctaggaaggtgtgggaagggaggttgatgggaagagaggcccctggaaatggggcctggtgcaacgcggggtatcttctgtgaaaccagctgctgaaggtgtgcacaggaggcaagagaaatgccccagcatcctgggaagctcctgggcctctctttccatgccggtgggcctttgggctgcctttgcccacagaggctctgcgggtcctacccctgaccacatccacctttgctcacttccccagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagaggtaacggacagaggcaggcaggcatggggcggctattggaatcctatctgcagtataaatacttcaaaagaagcctgagcctcaagtcccagatcaggggagggagcttggacagagaaaggtctctggtaaaggggggcaatgacactggagaaggagctcaactttgggatctgctgctgccaatcgccatgctggggcgacctctccttccttcctgccttctctagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaaggtaggtggggcttgaaagtgggagagaagcaagccagcagtggccatccatggagccctccaattgtgtatccatcatgcaaccatcaatccgccctaattttccaacccccagccctttcatcctcttatccctccgtccatgcccccgtctaatccatctcccatcccttccccatgcatctattcatgcatctgtccatccatctatccatcctctacctttccattcatctgtccatttatccatccattcatctacctatctatccatctgtccaccatccatccatccatccatttatctacccatctatccatccatccatcctctacctatccatccatctgtccatttatccattcatccattcatctacctatctatctatctgtccatcatccatccatccatttatccatccatccatccgtccatccattcgtctacatatctatccatccatccatccatccatccacctatccatccatctgtccatccattcatctacctattcatctatctgtccatctttccatatctatctctccatttttcatctgtttatctccttatctgtccagatgcctatttatccattcctccatctctaagcaatcattcctatagcaatttatccatgcatttatctgtccattcgtgcatctattcattcttctctacattcacccatgaatctatctatgtattcatctactcatatagatctctctatgtgttcacacttctatacttccattcacacattcatgtctcttcgtctgcatatacttctacccatacttgcattgatctatccatctatctgttcagtcatttcctcatctatatccatctactcatccattcacccatccctgtgtccatctgcacccatccttctctatccatttatctgtctacccacgcatgcatccatccacggtaggtgttttctgaacattacattcctcaactggacactcaggctccctaagatctgaccacagctcacctccccagccacaactcaacagtccttcattcacactccaccaaaatacttgtgatcagtgaagctgctagggtccctcttgaatacactgatctttttgccaggagggcttttttgttgttgtttgtttgtttgtttgtttgagacagagtctcactctgttgcccaggctggagtg

SEQ ID NO: 2632 - DNA, 5275 bp, Homo sapiens
  ENST00000290039
gcggccgcccctctggctgctctgcctggtcgcgtgctggctcctgggcgccggggccgaagccgacttctccatcctggacgaggcgcaagtgctggcgagccagatgcggaggctggcggccgaggagctgggggtcgtcaccatgcagcggatattcaactcctttgtttacactgagaaaatctcaaatggagaaagtgaagtacagcagctagccaaaaaaatccgagagaagttcaaccgttacttggatgtggtcaatcggaacaagcaagttgtagaagcatcctatacggctcacctaacctctcccctaactgcaattcaagactgctgtactatcccaccttccatgatggaattcgatgggaactttaataccaatgtgtctagaacaattagttgtgatcgactttctactactgttaatagccgggccttcaatccaggacgagacttaaattcagttcttgcagacaacctgaaatccaaccctggaattaagtggcaatatttcagttcagaagaaggaattttcactgttttcccagcacacaagttccggtgtaagggcagctacgaacaccgcagtagacccatctacgtctctacagtccggccgcagtcaaagcacatagtagtgattctggaccacggggcttcagtcacagacactcagcttcagattgccaaggacgctgctcaggtcatcctcagcgccatcgatgaacatgacaagatttctgtgttaactgtggcagataccgtccggacttgctcactagaccagtgctataagaccttcttgtctccagccaccagtgagacaaaaaggaaaatgtccacctttgttagcagcgtgaagtcttcagacagtcctacccagcacgcagtgggattccaaaaggcatttcagctgattcgaagtacaaacaataacacaaagttccaagcaaatacagacatggtcatcatttacctgtcagctggcattacatcaaaggactcttcggaagaagataaaaaagcgactctccaagtcatcaatgaagaaaatagctttctaaacaactctgtaatgattctcacctatgccctcatgaacgatggggtgactggtttgaaagagctggcttttctgagggatctagctgaacagaattcagggaagtacggtgtgccagaccggatggccttgcctgtgattaagggcagcatgatggtgctgaatcagttgagcaacctggagaccacagtgggcaggttctacacaaaccttcccaaccggatgattgatgaagccgtcttcagcctgcccttctctgatgagatgggagatggtttgataatgactgtgagtaaaccctgttattttggaaacctacttctgggaattgtaggtgtggacgtgaatctggcttacattcttgaagacgtgacgtattaccaagactctttggcttcctatacttttctcatagacgacaaaggatatacacttatgcacccatctcttaccaggccatatttattgtcagagcccccacttcatactgacatcatacattatgaaaatattccaaaatttgaattagttcggcaaaatatcctaagcctccctctgggcagccagattatcgcagtccctgtgaactcatccctgtcttggcacataaacaagctgagagaaactggaaaggaagcctacaatgttagctatgcctggaagatggtacaagacacttcctttattctgtgtattgtggtgatacaaccagaaatacctgtgaaacaactgaagaacctcaacactgttcccagcagcaagctgctgtaccaccggctggatctccttggccagcccagtgcttgcctccacttcaaacagctggcaaccctagaaagtcccaccatcatgctgtctgctggcagcttttcctccccctatgagcacctcagccagccagagacaaagcgcatggtagagcactacaccgcctatctcagcgacaacacccgcctcattgctaacccgggcctcaaattctctgtcagaaatgaagtaatggctaccagccacgtcacagatgaatggatgacacaaatggaaatgagtagcctgaacacttacattgtccgccgttacatagcaacacccaatggcgtcctcagaatttatcctggttccctcatggacaaagcatttgatcccactaggagacaatggtatctccatgcagtagctaatccagggttgatttctttgactggtccttacttagatgttggaggagctggttatgttgtgacaatcagtcacacaattcattcatccagtacacagctgtcttctgggcacactgtggctgtgatgggcattgacttcacactcagatacttctacaaagttctgatggacctattacctgtctgtaaccaagatggtggcaacaaaataaggtgcttcataatggaggacaggggttatctggtggcgcacccgactctcatcgaccccaaaggacatgcacctgtggagcagcagcacatcacccacaaggagcccctggtagcaaatgatatcctcaaccaccccaactttgtaaagaaaaacctgtgcaacagcttcagtgacagaacggtccagaggttttataaattcaacaccagccttgcgggggatttgacgaaccttgtgcatggcagccactgttccaaatacagattagcaaggatcccaggaaccaacgcgtttgttggcattgtcaacgaaacctgcgactctcttgccttctgtgcctgcagcatggtggaccgactctgtctcaactgtcaccgaatggaacaaaatgaatgtgaatgtccttgtgagtgccctctagaggtcaatgagtgcactggcaacctcaccaatgcagagaaccgaaaccccagctgcgaggtccaccaggagccggtgacatacacagctattgaccctggcctgcaagatgctcttcaccagtgtgtcaacagcaggtgcagtcagaggctggaaagtggggactgttttggggtgctggattgtgaatggtgcatggtggacagtgatggaaagactcacctggacaaaccctactgtgccccccagaaagaatgcttcggggggattgtgggagccaaaagtccctacgttgatgacatgggagcaataggtgatgaggtgatcacattaaacatgattaaaagcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaaccgtatgcaatggaccatt

SEQ ID NO: 2633 - DNA, 5547 bp, Homo sapiens
  ENST00000495994
cccctcgctgttctgcccctttgtcttccacgcctgccccttcaactcctcttgccctgcaaaccccgggtcgccacctccacatcccttccacttctacctgcctgccttggcctgcattttattttcaaccaaggttgaaatggtagccccacgcaaaatccgatggtgtgtggaggaactgcccagtcattgcagtctgcacgccttcttaagtgccaggtgcgagcaaggccgaccaggaactgccgatgggcttcacctgtcagactggactgccacctgccacacattcattgaacttttaataagcactgccgctgtgcttggcgttttgctgggctccagaaataaaaaattcagagaggccaaagttcttcagggatgcagacaggtgatagaaccatcatttattgagcacttgctaagtgctaaatactcttacctgcgttatcttgtgtaatcctcacaaccacactcaacgacggcctattgaatgctctctaggtgtctggcagtgttccaaacagtttatgtgtattactttgtttgatcttcccaaccaccaatgagcggatattcaactcctttgtttacactgagaaaatctcaaatggagaaagtgaagtacagcagctagccaaaaaaatccgagagaagttcaaccgttacttggatgtggtcaatcggaacaagcaagttgtagaagcatcctatacggctcacctaacctctcccctaactgcaattcaagactgctgtactatcccaccttccatgatggaattcgatgggaactttaataccaatgtgtctagaacaattagttgtgatcgactttctactactgttaatagccgggccttcaatccaggacgagacttaaattcagttcttgcagacaacctgaaatccaaccctggaattaagtggcaatatttcagttcagaagaaggaattttcactgttttcccagcacacaagttccggtgtaagggcagctacgaacaccgcagtagatttctgtgttaactgtggcagataccgtccggacttgctcactagaccagtgctataagaccttcttgtctccagccaccagtgagacaaaaaggaaaatgtccacctttgttagcagcgtgaagtcttcagacagtcctacccagcacgcagtgggattccaaaaggcatttcagctgattcgaagtacaaacaataacacaaagttccaagcaaatacagacatggtcatcatttacctgtcagctggcattacatcaaaggactcttcggaagaagataaaaaagcgactctccaagtcatcaatgaagaaaatagctttctaaacaactctgtaatgattctcacctatgccctcatgaacgatggggtgactggtttgaaagagctggcttttctgagggatctagctgaacagaattcagggaagtacggtgtgccagaccggatggccttgcctgtgattaagggcagcatgatggtgctgaatcagttgagcaacctggagaccacagtgggcaggttctacacaaaccttcccaaccggatgattgatgaagccgtcttcagcctgcccttctctgatgagatgggagatggtttgataatgactgtgagtaaaccctgttattttggaaacctacttctgggaattgtaggtgtggacgtgaatctggcttacattcttgaagacgtgacgtattaccaagactctttggcttcctatacttttctcatagacgacaaaggatatacacttatgcacccatctcttaccaggccatatttattgtcagagcccccacttcatactgacatcatacattatgaaaatattccaaaatttgaattagttcggcaaaatatcctaagcctccctctgggcagccagattatcgcagtccctgtgaactcatccctgtcttggcacataaacaagctgagagaaactggaaaggaagcctacaatgttagctatgcctggaagatggtacaagacacttcctttattctgtgtattgtggtgatacaaccagaaatacctgtgaaacaactgaagaacctcaacactgttcccagcagcaagctgctgtaccaccggctggatctccttggccagcccagtgcttgcctccacttcaaacagctggcaaccctagaaagtcccaccatcatgctgtctgctggcagcttttcctccccctatgagcacctcagccagccagagacaaagcgcatggtagagcactacaccgcctatctcagcgacaacacccgcctcattgctaacccgggcctcaaattctctgtcagaaatgaagtaatggctaccagccacgtcacagatgaatggatgacacaaatggaaatgagtagcctgaacacttacattgtccgccgttacatagcaacacccaatggcgtcctcagaatttatcctggttccctcatggacaaagcatttgatcccactaggagacaatggtatctccatgcagtagctaatccagggttgatttctttgactggtccttacttagatgttggaggagctggttatgttgtgacaatcagtcacacaattcattcatccagtacacagctgtcttctgggcacactgtggctgtgatgggcattgacttcacactcagatacttctacaaagttctgatggacctattacctgtctgtaaccaagatggtggcaacaaaataaggtgcttcataatggaggacaggggttatctggtggcgcacccgactctcatcgaccccaaaggacatgcacctgtggagcagcagcacatcacccacaaggagcccctggtagcaaatgatatcctcaaccaccccaactttgtaaagaaaaacctgtgcaacagcttcagtgacagaacggtccagaggttttataaattcaacaccagccttgcgggggatttgacgaaccttgtgcatggcagccactgttccaaatacagattagcaaggatcccaggaaccaacgcgtttgttggcattgtcaacgaaacctgcgactctcttgccttctgtgcctgcagcatggtggaccgactctgtctcaactgtcaccgaatggaacaaaatgaatgtgaatgtccttgtgagtgccctctagaggtcaatgagtgcactggcaacctcaccaatgcagagaaccgaaaccccagctgcgaggtccaccaggagccggtgacatacacagctattgaccctggcctgcaagatgctcttcaccagtgtgtcaacagcaggtgcagtcagaggctggaaagtggggactgttttggggtgctggattgtgaatggtgcatggtggacagtgatggaaagactcacctggacaaaccctactgtgccccccagaaagaatgcttcggggggattgtgggagccaaaagtccctacgttgatgacatgggagcaataggtgatgaggtgatcacattaaacatgattaaaagcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaaccgtatgcaatgga

SEQ ID NO: 2634 - DNA, 5260 bp, Homo sapiens
  ENST00000470527
agataccatggagacaaggccaaaggggttaggaaacttttctctagtcttttttggacagcctcagtaagggtagtgtgggatacagaatcaaagagcctcatcttttgagatggaaaactcaaggtccaagcaagactctgtcatttactgtttgatttgtaacagctagccaaaaaaatccgagagaagttcaaccgttacttggatgtggtcaatcggaacaagcaagttgtagaagcatcctatacggctcacctaacctctcccctaactgcaattcaagactgctgtactatcccaccttccatgatggaattcgatgggaactttaataccaatgtgtctagaacaattagttgtgatcgactttctactactgttaatagccgggccttcaatccaggacgagacttaaattcaggggtcgagaactgagctgcagtatctccaagttcttgcagacaacctgaaatccaaccctggaattaagtggcaatatttcagttcagaagaaggaattttcactgttttcccagcacacaagttccggtgtaagggcagctacgaacaccgcagtagacccatctacgtctctacagtccggccgcagtcaaagcacatagtagtgattctggaccacggggcttcagtcacagacactcagcttcagattgccaaggacgctgctcaggtcatcctcagcgccatcgatgaacatgacaagatttctgtgttaactgtggcagataccgtccggacttgctcactagaccagtgctataagaccttcttgtctccagccaccagtgagacaaaaaggaaaatgtccacctttgttagcagcgtgaagtcttcagacagtcctacccagcacgcagtgggattccaaaaggcatttcagctgattcgaagtacaaacaataacacaaagttccaagcaaatacagacatggtcatcatttacctgtcagctggcattacatcaaaggactcttcggaagaagataaaaaagcgactctccaagtcatcaatgaagaaaatagctttctaaacaactctgtaatgattctcacctatgccctcatgaacgatggggtgactggtttgaaagagctggcttttctgagggatctagctgaacagaattcagggaagtacggtgtgccagaccggatggccttgcctgtgattaagggcagcatgatggtgctgaatcagttgagcaacctggagaccacagtgggcaggttctacacaaaccttcccaaccggatgattgatgaagccgtcttcagcctgcccttctctgatgagatgggagatggtttgataatgactgtgagtaaaccctgttattttggaaacctacttctgggaattgtaggtgtggacgtgaatctggcttacattcttgaagacgtgacgtattaccaagactctttggcttcctatacttttctcatagacgacaaaggatatacacttatgcacccatctcttaccaggccatatttattgtcagagcccccacttcatactgacatcatacattatgaaaatattccaaaatttgaattagttcggcaaaatatcctaagcctccctctgggcagccagattatcgcagtccctgtgaactcatccctgtcttggcacataaacaagctgagagaaactggaaaggaagcctacaatgttagctatgcctggaagatggtacaagacacttcctttattctgtgtattgtggtgatacaaccagaaatacctgtgaaacaactgaagaacctcaacactgttcccagcagcaagctgctgtaccaccggctggatctccttggccagcccagtgcttgcctccacttcaaacagctggcaaccctagaaagtcccaccatcatgctgtctgctggcagcttttcctccccctatgagcacctcagccagccagagacaaagcgcatggtagagcactacaccgcctatctcagcgacaacacccgcctcattgctaacccgggcctcaaattctctgtcagaaatgaagtaatggctaccagccacgtcacagatgaatggatgacacaaatggaaatgagtagcctgaacacttacattgtccgccgttacatagcaacacccaatggcgtcctcagaatttatcctggttccctcatggacaaagcatttgatcccactaggagacaatggtatctccatgcagtagctaatccagggttgatttctttgactggtccttacttagatgttggaggagctggttatgttgtgacaatcagtcacacaattcattcatccagtacacagctgtcttctgggcacactgtggctgtgatgggcattgacttcacactcagatacttctacaaagttctgatggacctattacctgtctgtaaccaagatggtggcaacaaaataaggtgcttcataatggaggacaggggttatctggtggcgcacccgactctcatcgaccccaaaggacatgcacctgtggagcagcagcacatcacccacaaggagcccctggtagcaaatgatatcctcaaccaccccaactttgtaaagaaaaacctgtgcaacagcttcagtgacagaacggtccagaggttttataaattcaacaccagccttgcgggggatttgacgaaccttgtgcatggcagccactgttccaaatacagattagcaaggatcccaggaaccaacgcgtttgttggcattgtcaacgaaacctgcgactctcttgccttctgtgcctgcagcatggtggaccgactctgtctcaactgtcaccgaatggaacaaaatgaatgtgaatgtccttgtgagtgccctctagaggtcaatgagtgcactggcaacctcaccaatgcagagaaccgaaaccccagctgcgaggtccaccaggagccggtgacatacacagctattgaccctggcctgcaagatgctcttcaccagtgtgtcaacagcaggtgcagtcagaggctggaaagtggggactgttttggggtgctggattgtgaatggtgcatggtggacagtgatggaaagactcacctggacaaaccctactgtgccccccagaaagaatgcttcggggggattgtgggagccaaaagtccctacgttgatgacatgggagcaataggtgatgaggtgatcacattaaacatgattaaaagcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaaccgtatgcaatggaccatt

SEQ ID NO: 2635 - DNA, 564 bp, Homo sapiens
  ENST00000486580
aagctttagggttagtgtgtatatatgtgtatattaatgactcgctataggatttttcttcttaaactcagaaagcctaggtagggtgaacaattgagtgatcacgcatctgctgactgtatttctgcaagcttttattttcaccaagtttggttgcatccatctgctgtggaaagatttttaaaaagtaattcggcttggcttctctgcaacagagctttgggaacactgccagcagcccactctcttttcatgtgagttttaaaggatccctgctatgtcttcctttgtttcccagttctctgtcagaaatgaagtaatggctaccagccacgtcacagatgaatggatgacacaaatggaaatgagtagcctgaacacttacattgtccgccgttacatagcaacacccaatggcgtcctcagaatttatcctggttccctcatggacaaagcatttgatcccactaggagacaatggtatctccatgcagtagctaatccagggttgatttctttgactggtccttacttagatgttggaggagctggttatgttgtgac

SEQ ID NO: 2636 - DNA, 8627 bp, Homo sapiens
  ENST00000360228
atgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatgctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 2637 - DNA, 8648 bp, Homo sapiens
  ENST00000637769
tctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatatctccccctctcggcttaggcaagaaatgtcctcatagggttgcttgcaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatc

SEQ ID NO: 2638 - DNA, 8657 bp, Homo sapiens
  ENST00000635895
cctcccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaat

SEQ ID NO: 2639 - DNA, 8665 bp, Homo sapiens
  ENST00000638009
cgcaccctcctcccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatatctccccctctcggcttaggcaagaaatgtcctcatagggttgcttgcaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaat

SEQ ID NO: 2640 - DNA, 3765 bp, Homo sapiens
  ENST00000587525
caggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatatctccccctctcggcttaggcaagaaatgtcctcatagggttgcttgcaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaa

SEQ ID NO: 2641 - DNA, 8340 bp, Homo sapiens
  ENST00000637736
atgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatatctccccctctcggcttaggcaagaaatgtcctcatagggttgcttgcaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaac

SEQ ID NO: 2642 - DNA, 8137 bp, Homo sapiens
  ENST00000636389
ccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatatctccccctctcggcttaggcaagaaatgtcctcatagggttgcttgcaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgct

SEQ ID NO: 2643 - DNA, 2693 bp, Homo sapiens
  ENST00000585802
gtcatggcttttgggattctgaattatttccgcgatgcctggaacatcttcgactttgtgactgttctgggcagcatcaccgatatcctcgtgactgagtttgggaatccgaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcac

SEQ ID NO: 2644 - DNA, 7809 bp, Homo sapiens
  ENST00000637432
gatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggtggaggcggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaatccgaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcacc

SEQ ID NO: 2645 - DNA, 7814 bp, Homo sapiens
  ENST00000638029
gatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggtggaggcggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaatccgaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcacc

SEQ ID NO: 2646 - DNA, 7500 bp, Homo sapiens
  ENST00000636012
atggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgagg

SEQ ID NO: 2647 - DNA, 7536 bp, Homo sapiens
  ENST00000635727
atggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgagg

SEQ ID NO: 2648 - DNA, 7569 bp, Homo sapiens
  ENST00000573710
gcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatgttggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatatctccccctctcggcttaggcaagaaatgtcctcatagggttgcttgcaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgag

SEQ ID NO: 2649 - DNA, 7135 bp, Homo sapiens
  ENST00000637276
atggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccg

SEQ ID NO: 2650 - DNA, 6847 bp, Homo sapiens
  ENST00000637927
gcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatgttggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatatctccccctctcggcttaggcaagaaatgtcctcatagggttgcttgcaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagtagttccgtaagtggaagcccagccccctc

SEQ ID NO: 2651 - DNA, 1653 bp, Homo sapiens
  ENST00000636473
gtcatggcttttgggattctgaattatttccgcgatgcctggaacatcttcgactttgtgactgttctgggcagcatcaccgatatcctcgtgactgagtttgggaatccgaataacttcatcaacctgagctttctccgcctcttccgagctgcccggctcatcaaacttctccgtcagggttacaccatccgcattcttctctggacctttgtgcagtccttcaaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagtag

SEQ ID NO: 2652 - DNA, 6792 bp, Homo sapiens
  ENST00000636549
atggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaatccgaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagtag

SEQ ID NO: 2653 - DNA, 3011 bp, Homo sapiens
  ENST00000636610
ccccgtcagtggggggctgcctgcctgctgcttctcagaggaatgatgtggtctgtgcccatctgctctgtcctggtctgggccaagccagggattgggtgtggggagccagtggcaccccccaccagcggctgtggtcctggccccctcagccttggctgttgcatgcactgctcaaatccagcttgtgctctttttctttggggtcagactgaaacggggccatccagaagaactctggggcagggcgggggtggggcaagggttgaggcaaaccctggaaatgccagctctcaggtcaagcaggtgggggaaaaaaggagagggcaggggaccagaagtacaagagagccttttgtgccctccctgcgggccaccaagagaaactgagtactgggacaggtaacctaagtaagagacacctcagccgccacagctttcagagttcttcctgggactccctgggtaggggcgggcgcggctcacgggagacccaggagggatgcctgggaatgactgcgcttgccttgggttttctgtagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccaggtgagggctttcaccactgccctggggctggacccctcactctgcactgggtagggccaggcccccccacaagcagcccagtgcatcccctccctgccggactcaggcctgggtagggactccttcagtctctgaagcagtctgcaggccccacccaccacctggtcacacctggagcacctgcagaccctcctccctcacagaggacagagaggaaagtgctccccctggggcagagggcagtggccactgcaaaatggtctctggctgccctggttggaggctgcagacaggggaggttgtggaagatttgtgggtgcagcagggttcaacagggccagctgagacctgccacgaagatcacccctacacaaacacacacacacatgctcaacatacatgcacacacatgtgcagctgtgcgcctactcagatgcttgcatacacacacgtgtgtgcacgtgggcatatacacactgcacatgtactcacacatgcacacatgtacgtgcacacgtgtctgcatatgggaacttggcaggtcctaggatacagtagcagagtctggggtgggtctgggggcagctgggctcgtattttctgtctggtctctgtgggagtcattggggggcacaggggtgtgtgcttgatgtgtgtctgtgtgtggccgcttcacccagctgccaggcccacctgcaggtgatcccgttgccttggactcatgggacagagggcccagaggcatagctggctgcccacccggcctgaacagcgggggcccatgcacgcagcccgcctctggaggagaacagggcatggctgtgagagcctggcccgggtgcgtggcatgtgtggctgtggcgagctttccgtgtgccgtgtgtggcgtctgcacggggcaggaggctgtgctgtgcctggctggaccagggtcacctgagggcctggcctctggctgctgggaacgtgggttggggagcacccagcgtgcatgctgctgctccctcaggaccgagctgctgggccccaggagagggttgggacaagcccagctgacggccaccacatggaagctttgagcatcggccggagccaggggttggggtgtgcatcgcatgaggcagagcccagggccaggggctcgaggctgcgccgtcctgtctttcggtcccatgcctctgccatttgtctgtctgcatctcctgtctgtctcctctgtacccatgggaatagaggacgcccagccccgggggcctgggacacccacccgccaggactttaacttttcttttcctccctgccttctccctccgatttctcttgatgccagtgccactcccctccttggcttcttctccatgcaccacctcctcactctccctcttgccttttatatttattttcttctttctgttttttctgtgtgcaccatcccatggggctgtgacagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccacca

SEQ ID NO: 2654 - DNA, 1034 bp, Homo sapiens
  ENST00000636768
tccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagac

SEQ ID NO: 2655 - DNA, 1378 bp, Homo sapiens
  ENST00000637819
gatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaatccgaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatatctccccctctcggcttaggcaagaaatgtcctcatagggttgcttgcaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagc

SEQ ID NO: 2656 - DNA, 1516 bp, Homo sapiens
  ENST00000636074
gttcgagaccagcttgaccaacatggtgaaactccgtctctactaaaaatacaaaaaattagccaggcatggtggtgcatgtctgtaatcccagctactcgggaagctgagacaggagaattgcttgaacccaggagtcggaggttgcagtgagccaagctcgtgccactgcactccagcctgggcaacagagcaagactctgtctaaaaaaaaaaaaaaaacacacacacacacacacaacaaccaggtgaggcaagtactcttgctatcatctccatttcacagatggagaaactgagttactaagtggtagagtaacctaagtcatgcagccgataactgggagacaagattgggacccaggtcgcccagctgttctccatgccgggctgtctcctgcacagctgctccatggtcctggccccaccgaaaaccagagcccacaaggtcattccagcagcactgcccagggcctcctctgggccaggccgttggggaactggagaccccatggggaccagaaagattggggtctcgttctcgggagcctatggctttgcagctgacccagagtccagctgacacccaggcaggcagtcagggtctgtctacacccccattgcaggaggagccgacaaacagcagatggacgctgagctgcggaaggagatgatggcgatttggcccaatctgtcccagaagacgctagacctgctggtcacacctcacaagtgtaagagctgagcccagccctgggatccaatccaccaggacagatggagggggagggaaaggggaggcctggggagagtgttggcctgggctggtatacacagggacccaggacaagggccccaaagaggcctgcccttggtgagctcaccgtgtgtgtgcccccagccacggacctcaccgtggggaagatctacgcagccatgatgatcatggagtactaccggcagagcaaggccaagaagctgcaggccatgcgcgaggagcaggtgcgctgttcgccgctctggggacatctgggctggggacagtggcttgcatgtcaccacgggaaccaactggaatatgagggtggctgagccccagggcaggtccctgaaaagtaggggctgtgcacagcagctcacacctgcaatctcagtgctttgagaggccagggcagagggatcgtttgagaccaggatgagaccaccctgggcaacacagtgagactccatctctacaaaataaaacattagccaggcatggtggtgcacacctgtagtcccagctatttaggaggccaagatgggaggatcacttgaggccaggagtgggagaccagtctgggcaacatagaaagacccatatctctacaaaaaaaaaataaaattagctgcatgtggcgccatgcacctgtggtcccagctacttgggaggctgaggcaggagaatcacttgaacctgggaggtggaggttgcagcaagccaagatcaagccactgcactccagcccgggtgata

SEQ ID NO: 2657 - DNA, 2548 bp, Homo sapiens
  ENST00000635988
aagaagttcagggatgacctttaaagattctccccacccaaaaagtattaccccatcatcctattctcccatccaccttgatcttccctgcgtccctatccatcaatgctatttgtacctgccccgtgttgccacctcattcctttccttcctctgtgcacccctcctcacctaacctatatgtctcccctccttctcaatcaaagccggggacaaggttgtcccaccagcatctcagacaatgagcctctcctggcacctgtcgctctgtgcccctccctgccgcccccccccccccccccggttttcctcaagtcgcttctctcagtctctgcttagatgaatgtgtgcgcatgtgcaagagagggagggcgagcccttcctctcctggtctttgtgcaggaccaccatgggtccataagacaactttgtgcaaatttgaaaaaggcaccctttccacagaacatgcctgttggaaaattgttgcaatctaccaatgtggtgagaacaagacactttttttctatcacctgggaagctgttatatttaatatacaaatcgggggctgggcgtggtggctcatgcctgtaatcctagtgctttgggaggctgagacgggaggatcacttgagcccagttcgagactagcctgggcaacatagcgagaccccatctctacaaaaagaaaaaatattttaattaataaataagtacataaatctatcatttccaagatgggagccctttgtgcggtgtacaacctgcacaactgtgcacagtggcccagtctatgtgtgtttctctatttcccacctccttccccaccctacccccagtgtcccctccagtgtcctgctctggatttaccatacccctccccatcttcaactctgtgtttcctgcccacttgtgtctgaatccccacccaagttgccctcaccccccttctctgtgccacttcagcctgggctggtgcacaccagcccagcatcctctcccatgccaccaagcatggtggacagagcccctgcctgggacatggggaatcttttcttccctgggctggaagggagtgcccctcaccccttccccctgccattgcacagagagccaagatctggacatgcccctgagatacacttcccacggagctatgaatgagtctcgagattccgtctgcatgcgcccctgtctgtgctgttctgtgtcacagcctcgctgcatgcctgcgaggggcctgccccgtcagtggggggctgcctgcctgctgcttctcagaggaatgatgtggtctgtgcccatctgctctgtcctggtctgggccaagccagggattgggtgtggggagccagtggcaccccccaccagcggctgtggtcctggccccctcagccttggctgttgcatgcactgctcaaatccagcttgtgctctttttctttggggtcagactgaaacggggccatccagaagaactctggggcagggcgggggtggggcaagggttgaggcaaaccctggaaatgccagctctcaggtcaagcaggtgggggaaaaaaggagagggcaggggaccagaagtacaagagagccttttgtgccctccctgcgggccaccaagagaaactgagtactgggacaggtaacctaagtaagagacacctcagccgccacagctttcagagttcttcctgggactccctgggtaggggcgggcgcggctcacgggagacccaggagggatgcctgggaatgactgcgcttgccttgggttttctgtagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggtgcgctgttcgccgctctggggacatctgggctggggacagtggcttgcatgtcaccacgggaaccaactggaatatgagggtggctgagccccagggcaggtccctgaaaagtaggggctgtgcacagcagctcacacctgcaatctcagtgctttgagaggccagggcagagggatcgtttgagaccaggatgagaccaccctgggcaacacagtgagactccatctctacaaaataaaacattagccaggcatggtggtgcacacctgtagtcccagctatttaggaggccaagatgggaggatcacttgaggccaggagtgggagaccagtctgggcaacatagaaagacccatatctctacaaaaaaaaaataaaattagctgcatgtggcgccatgcacctgtggtcccagctacttgggaggctgaggcaggagaatcactt

SEQ ID NO: 2658 - DNA, 517 bp, Homo sapiens
  ENST00000638114
ggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggtgcgctgttcgccgctctggggacatctgggctggggacagtggcttgcatgtcaccacgggaaccaactggaatatgagggtggctgagccccagggcaggtccctgaaaagtaggggctgtgcacagcagctcacacctgcaatctcagtgctttgagaggccagggcagagggatcgtttgagaccaggatgagaccaccctgggcaacacagtgagactccatctctacaaaataaaacattagccaggcatggtggtgcacacctgtagtcccagctatttaggaggccaagatgggaggatcacttgaggccaggagtgggagaccagtctgggcaacatagaaagacccatatctct

SEQ ID NO: 2659 - DNA, 459 bp, Homo sapiens
  ENST00000586190
tgccctccctgcgggccaccaagagaaactgagtactgggacaggtaacctaagtaagagacacctcagccgccacagctttcagagttcttcctgggactccctgggtaggggcgggcgcggctcacgggagacccaggagggatgcctgggaatgactgcgcttgccttgggttttctgtagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtgtaagagctgagcccagccctgggatccaatccaccaggacagatggagggggagggaaag

SEQ ID NO: 2660 - DNA, 740 bp, Homo sapiens
  ENST00000636670
tctctgcatctttctctctctattttttcggctcgtgtggatttcttttttctttcttctgtttctccccacctctcttcctttggttctctgttcccattcccgttttgtttttttgtttttgtttttgtttttttcattttcggtgctgccaggggccgcatgccttacctggacatgtatcagatgctgagacacatgtctccgcccctgggtctggggaagaagtgtccggccagagtggcttacaaggtagactacccttgccgaccaccgacgtccaggcactgggtttttttttcttcttcttcttctttttttttagtgctgaccagaaacacccggccgactctctttttccaacgtttctcttcttttttgtttttgattcttttttttcttttctcgagtcaactgatcatgaccatcccttgattctaagcagcacactgtgtccgtcctttctgatgagtgtcttcgtgttttgagactccattatggccgacatgccggggggagggggaggggagcgcccaggtccccttgcacctggtctcccaggtaccaaattggaaacaaacacgcttcttcagggagtcaaaacccatgcttcccacttctgcccacccagagcggcccccatgcccaggctggggcaggcgccttgcagagaggggctttagcccccgaaagcaggcgaggtcccgggtccccgcccctgccacgcacacctgaagctg

SEQ ID NO: 2661 - DNA, 701 bp, Homo sapiens
  ENST00000637832
acttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatatctccccctctcggcttaggcaagaaatgtcctcatagggttgcttgcaaggtttgacttccactaaaacctgctagcatccatggaatgagtgtggcttggggttcttcaatatatatatttcatatatata

SEQ ID NO: 2662 - DNA, 728 bp, Homo sapiens
  ENST00000637777
cagcatcaccgatatcctcgtgactgagtttgggaatccggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaaggggaataacttcatcaacctgagctttctccgcctcttccgagctgcccggctcatcaaacttctccgtcagggttacaccatccgcattcttctctggacctttgtgcagtccttcaaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcg

SEQ ID NO: 2663 - DNA, 806 bp, Homo sapiens
  ENST00000574822
tatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggtcacagcaattggatgctgtccccaaggcctctattccacaagccccccccca

SEQ ID NO: 2664 - DNA, 1910 bp, Homo sapiens
  ENST00000635742
atcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggtaagaagtcaccccgaatcctccagccacaatactcacctctccctggaactggaacacgggctaggtcaggccccagactctggagcactgaactcctggggtcctagcaggggtctcacaggttcagtcaggagagaagatataagaatcatcacccttgcataccccagattaaacacgtagggtgccaaccctgcccaaaccctggactttctgggaaatgagggagggcgtcaaccatgagatgtcctgaagagccctctcctcctacgagtctctcctgtctctcactgtgaagtctccagatggtgaggatgcattagccaggctccagggagaaaaccaacagcatcccagcctcagttctcttgagagtgtggggaggagggc

SEQ ID NO: 2665 - DNA, 871 bp, Homo sapiens
  ENST00000637809
gtggagctgaagcagggtctggaggccccctctggggccaggccaatcatgggaaggcccccaggagttcccagggagggagactcagcacagatgatgtcgaacagcctttaccgcagcccttcgaacaaccataactgtcccgggcactccgctgatgggcaactgtgcctctaacatgcacccggccagcctagggggccgggaaccaagccctctgttggcatctctgtcttgtgggtccccattctagaattatttccgcgatgcctggaacatcttcgactttgtgactgttctgggcagcatcaccgatatcctcgtgactgagtttgggaatccgaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccac

SEQ ID NO: 2666 - DNA, 896 bp, Homo sapiens
  ENST00000573891
gaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttggggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaaggggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggccccca

SEQ ID NO: 2667 - DNA, 656 bp, Homo sapiens
  ENST00000636058
ttctgaattatttccgcgatgcctggaacatcttcgactttgtgactgttctgggcagcatcaccgatatcctcgtgactgagtttgggaatccggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaaggggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagt

SEQ ID NO: 2668 - DNA, 637 bp, Homo sapiens
  ENST00000637297
ctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagt

SEQ ID NO: 2669 - DNA, 567 bp, Homo sapiens
  ENST00000593267
attgcattaatagtgctttctctctccctccttatttggggtctggcttgcttttttcctgttggttggcttcatgtaggggcctctgtgagtggtgacagctctgagccttttggggtgggtggatggtcacccctcttcctccatctccccagaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggtgagaaggggacctgctctgataattctgtttccgtggggtggggtgcctgccttcatccttctgttcccatagaggatgtaccctcctcttccaatgcaagacgtgccctc

SEQ ID NO: 2670 - DNA, 1975 bp, Homo sapiens
  ENST00000637475
gataacccttccctccaggatcttcatgaggagctcagtgatgtcatttataaagcccctggggtctcgggagccctcaaaaatgctggagagacaggccacagctctgaagagcagccccagccctgtggagctgaagcagggtctggaggccccctctggggccaggccaatcatgggaaggcccccaggagttcccagggagggagactcagcacagatgatgtcgaacagcctttaccgcagcccttcgaacaaccataactgtcccgggcactccgctgatgggcaactgtgcctctaacatgcacccggccagcctagggggccgggaaccaagccctctgttggcatctctgtcttgtgggtccccattctagaattatttccgcgatgcctggaacatcttcgactttgtgactgttctgggcagcatcaccgatatcctcgtgactgagtttggggtaagtctccctccagcttctctctgggtgactctgggctggacgaggcaggcggcagggggcgggggagcggtcccagaggcagtgtgtcccggaagccatagctgcttgagccagcacttggccatgaccagagagggagaactggggccccggggacaagggcagcccctcaggagggcattgtggggagatgggggtaaccaaagcttggctgtagggccagcactgaggggtgggctttcctgcatcctggcctaggaattaataatgcagatgagtacactgagggaactgagacactcaaaagctctgaaagctgagccggctcccaaacaccaccctatgtcaggagcccagaaagaatgggtttcaagtcaattctgtttgaaccaaccctctcctagttagtgggcaggagagagccacagccctcaggccagtgtggggacaccactcccagggccatagaggggtccccagggtgtcttccctcctctagccccgggcctgggagactctcaacatgggagtctctggacctctctgtggtggccccacaggccacattgcccttctccttttctggaagactcagggccccagaggtcctgtcctagaccctctccttggccatctgccaatgagcccaggcttggggtccctcaggagattggggggagggtagaagatccttgcagggggaagcaatggtcaaaaaagggtgtcaaagccaagggtcaagggtgataccaatgtcatcttactaacaataaaaataacaatagctcacgagaatcgcagccttgctgtgtgccagggaactgtgccaagtggtttacgtggattggctcagggtagaggtcttggtctcagctcgtaagagaattccctcggagggttcaactgaaggcacccaaatgcagacctcactggtggaggggaagggaagggtacccacaagggtggcaaggtgtccagcgaccacccaccgtggggagctgtcacctgcccaggtgctgaagtggggagggaacctgagccggaggccaggagaagccaccaagtgggagctgtcctgtcaatgtggagagacagagaccagggcccaagcaggcagagagcaataggggagaaacaccccaacctttctctcccctcatcccttatctcctgccagagcctcccatggcccaaagtaaaccggaagcaagctgaatatgatgctcagagcaggcagggaagtcaggagaatagatctgggtgtggtcgggcctgaggaagagggtgttgcctcatttcacagatgggaaaactgacctcagctgggcacggtggctcatgcctgtaatcccagcactttgggaggccgaagccggcggatcacctgaggccaggagttcaagaccagcctggccaacatggtgaaaccccatctctactgacaatacaaaaaaattagccaggtgtggtggtgcatgcctgtaatcccagctactcgggaggctgag

SEQ ID NO: 2671 - DNA, 2829 bp, Homo sapiens
  ENST00000637004
aaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttggggtaagtctccctccagcttctctctgggtgactctgggctggacgaggcaggcggcagggggcgggggagcggtcccagaggcagtgtgtcccggaagccatagctgcttgagccagcacttggccatgaccagagagggagaactggggccccggggacaagggcagcccctcaggagggcattgtggggagatgggggtaaccaaagcttggctgtagggccagcactgaggggtgggctttcctgcatcctggcctaggaattaataatgcagatgagtacactgagggaactgagacactcaaaagctctgaaagctgagccggctcccaaacaccaccctatgtcaggagcccagaaagaatgggtttcaagtcaattctgtttgaaccaaccctctcctagttagtgggcaggagagagccacagccctcaggccagtgtggggacaccactcccagggccatagaggggtccccagggtgtcttccctcctctagccccgggcctgggagactctcaacatgggagtctctggacctctctgtggtggccccacaggccacattgcccttctccttttctggaagactcagggccccagaggtcctgtcctagaccctctccttggccatctgccaatgagcccaggcttggggtccctcaggagattggggggagggtagaagatccttgcagggggaagcaatggtcaaaaaagggtgtcaaagccaagggtcaagggtgataccaatgtcatcttactaacaataaaaataacaatagctcacgagaatcgcagccttgctgtgtgccagggaactgtgccaagtggtttacgtggattggctcagggtagaggtcttggtctcagctcgtaagagaattccctcggagggttcaactgaaggcacccaaatgcagacctcactggtggaggggaagggaagggtacccacaagggtggcaaggtgtccagcgaccacccaccgtggggagctgtcacctgcccaggtgctgaagtggggagggaacctgagccggaggccaggagaagccaccaagtgggagctgtcctgtcaatgtggagagacagagaccagggcccaagcaggcagagagcaataggggagaaacaccccaacctttctctcccctcatcccttatctcctgccagagcctcccatggcccaaagtaaaccggaagcaagctgaatatgatgctcagagcaggcagggaagtcaggagaatagatctgggtgtggtcgggcctgaggaagagggtgttgcctcatttcacagatgggaaaactgacctcagctgggcacggtggctcatgcctgtaatcccagcactttgggaggccgaagccggcggatcacctgaggccaggagttcaagaccagcc

SEQ ID NO: 2672 - DNA, 1245 bp, Homo sapiens
  ENST00000637692
aatcagccaacccccttgtgctgggtctcagggacacccaatacagctgctcaggcccagccagatggcaaagggccctcaaccaaccctgggaccagaaccacaaaaagccacgtacttactggctcccgagcccaagcttaacaggtgaaatggaccactcttcaccaggaagggcagggctgtgccaagctcaccccagacttctaggcctgggagggtagggtcccatggagctgtgggctgccccctacccaacctgacctctgcttcctctcttcccttcttcccacctaaacattcctccacagtggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatc

SEQ ID NO: 2673 - DNA, 1832 bp, Homo sapiens
  ENST00000635917
tccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctggtaagtaccaccttggggctacagctatgggcttgggagaagcccaagggggaacaatgggtcctggatgatggtctcccaacgtggccccaagaaccccaacctcaagggtggcttcagtatcctgccagtggccacagatcctacttaggcattcttgtgtttgccaaggagtcccagggagacccaacctgtgagtgttaccatatggctgcttatgtatccagttcctcaaaatgatgggagtcatcatggctgggagtctttagcatccattttagagataagaaaactgaaatcaggctgggcgaggtgtctcatggctgtaattccagcactttgggaggccaaggtgggcggatcacctgaggtcgggagttcgagaccagcctgaccaacatggagaaactctgtctctactaaaaatacaaaattagccgggtgtggtggcgcatgcctgtaatcccagctact

SEQ ID NO: 2674 - DNA, 1978 bp, Homo sapiens
  ENST00000636816
ccactaaactcctagaccaagggcttttttgaaaatagctgtgaccaggtgtagtggctcacacctgtaatcccagcactttgagagggtgaggagggcagattgcttgagctcaggagtttgaaaccagcctgggcaacatggtgaaacctcatctctacaaaaagacaaaacaattagccaggcgcagtggcgtgtgcctgtagtcccagctacttgggaggctgaggtgggaggatggctttagcccaggaggcggaggttgcagtgagccgagatcgtgccactgcactccagccttggtgacagagccagaccctgtctcaaaaaagaaaaaagaaaagctgtgcagaaatgggggtggggaatcagccaacccccttgtgctgggtctcagggacacccaatacagctgctcaggcccagccagatggcaaagggccctcaaccaaccctgggaccagaaccacaaaaagccacgtacttactggctcccgagcccaagcttaacaggtgaaatggaccactcttcaccaggaagggcagggctgtgccaagctcaccccagacttctaggcctgggagggtagggtcccatggagctgtgggctgccccctacccaacctgacctctgcttcctctcttcccttcttcccacctaaacattcctccacagtggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctggtaagtaccaccttggggctacagctatgggcttgggagaagcccaagggggaacaatgggtcctggatgatggtctcccaacgtggccccaagaaccccaacctcaagggtggcttcagtatcctgccagtggccacagatcctacttaggcattcttgtgtttgccaaggagtcccagggagacccaacctgtgagtgttaccatatggctgcttatgtatccagttcctcaaaatgatgggagtcatcatggctgggagtctttagcatccattttagagataagaaaactgaaatcaggctgggcgaggtgtctcatggctgtaattccagcactttgggaggccaaggtgggcggatcacctgaggtcgggagttcgagaccagcctgaccaacatggagaaactctgtctctactaaa

SEQ ID NO: 2675 - DNA, 2979 bp, Homo sapiens
  ENST00000637168
cctccccgccttcaaaaaaaaaaaaaagtgaggctgaatcatggacttagtctttatttaaaattttgagccacttgtggtggctcatacctgttatcccagctactcaggaggctgaggtgggaggatcgcttgagcccaagagttcaaggctgcagtgagctgtgattatgccattgtactccagcctagacaacagaaggagacccctatccctgaaaaaaaaaaagaagaagaaattgatatttgttcatcatggactttttgcattaattttgattttttaaaatattggagcaaaagattatcttgattactgagattttcagtacccccttaatttgcacccaaaacaaatgcctccctccctcacctcgtccaagtaatggtctttctctcagaggtcttggaaatgccaggctggaagcttggtagattccagcatgtgccctcagcatcctcacctccctccctctctcagcaaatatgccaacctgaacatgccctactacccactctcagacacatccagtactcacacatgtgggaataatgctaacccacaaggcacctttgagcaaagtttttttaaacacctttctcaacagacttcatttccatctgtctgaaaatcatcgcaatagacttaaatgattttgttcaaacaaggcactgaaggaccacctgccaaaaaattgtcatcatgaatacacaaatctatcatgcctatcatgtgaaggtatcgcttagacacagagcctttgagcagtgtgcaacctgcactactgtacagagctgctgtgcacttacccactctcatatatatccccattgtacctcctgagcacccagcaccacctgtgctcaaatacccactctacatgcatacacccacctctactccctccattgccacaacctgtctttaaatcccaacttggccacttataagtgggtggtcttcagcacgtccctttaaattgctgaacctcaagttcctcatgtgcaaagtggagccagtaataacctccctgggagggttgctgagccggtggggatgaattgttgaatattgtttccagcacacagcaagcccttcatgcacagcagtagaaatgactgacattggccaggcgtggtggctcacacctgtaatctcaacagtttgggagaccgaggcaggtggatcacctgaggtcaggagttcaagaccagcctggccaacatggtgaaaccccgtctctactaaaaatacaaaaaaattagccaggcttggtggcgcatgtctgtaatcccagctacttgggaggctgaggcaggagaatcatttgaacccgggaggcggaggttgtagtgacccaagatcacgccgttgcactccagcctgggcaacgagagcgaaactccatctcaaaaaattaaaattaaaattaagaaataactgacattgttgtcagcctttcaaaaaacagcgactacttaaatttctttttcatttccctctgttcctgttctgccatctcacttccaccctctctccaccttcctcatcaccccttgggtccctgtctctctccttcctgccccttccctctccctgccccattccttgcagggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgaggtgccacttccaattccatctgtcctttaaaaactggggacacacacaaactttaaaacacacacaacacccaggaacccctttctaggggtacctgggggagggaacagaagcattgtcccaaccgaatccagtcttcagggcagcccttcatggagtttccagaggaaacacatcatatagtgtatgtatcagtcagtttagactaggttatgccgcagtaacaagcaaccccagatttcattgccaaatatccacaaagggacttattttttgctcacactgcatgtcaacatcagttgtggatcttgccatctttattctggttcccaggctggcagagcagcagagcagcctccctctgagatgctccagatgaaaaagagagtatgtcagactgaggttcagttcttcaggcttgtgctcaaaaattacacatgtcacttctgctcacatttcatcagccaaagcaagtcacacatccattctgacatcagtggagtgggcaaatacaatctcccctagcgaagggtggtgaatatttatgaatgaaaagccaagccaggtgtggtggctcacacctgtaatcccaacattttgggaagctgaggcaggaggatcacttgagctcaggagtttgagaccagcctggccaacatagcaagaccccatctctactacaaatcaaaaaaattagccaggcaggatggtgcacacctttagccccagtaacatgggaggctgaggtgggaggatgcttgagcttgggagttcgaggctgcagtgagctatcattatgccactgcactacagcctgggcaacagagcaagaccctctctcaaaaaaagaaaaggaaagaaaatccagtcccctgtctaccagagagtatagacatgactctttgcctctctggcatcatccaagctaaatagaggacctagaatatatcctctgctcccttgacccttaagacttaataaccactattcctccttctctctccctcaaagagaaggagaagacgcagcaaagtattcagtaagaaagaatgggctgggcgcagtggctcacgcctgtaatcttaacactttaggaggccaaggcaggaggattgcttgagcccggaagttcaagaccagcctgagcaacatagtgagaccc

SEQ ID NO: 2676 - DNA, 1968 bp, Homo sapiens
  ENST00000636984
attgttaccagtgtaaagtggcattttgcaacacatggtagcctgttgttatcttgatggctatttattgaaattaggaggatgccagatgtctggataggagtctggaactaacccttgtttcctgccttgaaaaggagtagcaacctcccttagcctgatgaacctctaaatgtcccctatgtctctctgcctcctcctaaactccctccaccccacccccagcaagcctgaggctctcaccctgaggactagaagttatcacgttggaagagggtgctggaccctgggtcagctctcccaccaggagtaaggttgtgccatcacccatggatttatctcaaagtagatgcacacgtcatcccctatgaagcacaggaacacatggtggcaggatggggagtcactgcttcccaagcagtctaggctggtggaccactcttcctttccctccccctgtctctgataaccaaagacaagtgcaagacagcccctctttcccatttactaacagtccccactctctgtggcagaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgaggtgccacttccaattccatctgtcctttaaaaactggggacacacacaaactttaaaacacacacaacacccaggaacccctttctaggggtacctgggggagggaacagaagcattgtcccaaccgaatccagtcttcagggcagcccttcatggagtttccagaggaaacacatcatatagtgtatgtatcagtcagtttagactaggttatgccgcagtaacaagcaaccccagatttcattgccaaatatccacaaagggacttattttttgctcacactgcatgtcaacatcagttgtggatcttgccatctttattctggttcccaggctggcagagcagcagagcagcctccctctgagatgctccagatgaaaaagagagtatgtcagactgaggttcagttcttcaggcttgtgctcaaaaattacacatgtcacttctgctcacatttcatcagccaaagcaagtcacacatccattctgacatcagtggagtgggcaaatacaatctcccctagcgaagggtggtgaatatttatgaatgaaaagccaagccaggtgtggtggctcacacctgtaatcccaacattttgggaagctgaggcaggaggatcacttgagctcaggagtttgagaccagcctggccaacatagcaagaccccatctctactacaaatcaaaaaaattagccaggcaggatggtgcacacctttagccccagtaacatgggaggctgaggtgggaggatgcttgagcttgggagttcgaggctgcagtgagctatcattatgccactgcactacagcctgggcaacagagcaagaccctctctcaaaaaaagaaaaggaaagaaaatccagtcccctgtctaccagagagtatagacatgactctttgcctctctggcatcatccaagctaaatagaggacctagaatatatcctctgctcccttgacccttaagacttaataaccactattcctccttctctctccctcaaagagaaggagaagacgcagcaaagtattcagtaagaaagaatgggctgggcgcagtggctcacgcctgtaatcttaacactttagg

SEQ ID NO: 2677 - DNA, 3340 bp, Homo sapiens
  ENST00000590205
gggggggactgtcagggttatcatgtacagctgagcaggttgtacactgctcaaggacaacacattaaaggaggtgctgataacatcctagccatcgtgtatggatatttgtattattacaacttcccagcagatggcagtaaagtgagctgacctaaaataatctgtgtattatggcagtttttctttagatgaagtgtcttggggttaagatcctttttcctaattcgcatgaaggcatcatatggatttaaaagggtataaccgtgatctgggaagcaggaactagatttcttgttccataaaattttgacttttcatctacctattctaggctctagtatctcccattccaaaatagcatgaaccagcatttcccaaaagcctgtcattcaaaaacatatatatatattaagggaaataaaatccagtcattagagcacccactttcactctatgcttcacctgggggtccccagtattatctcttatgtaatatgtttctttaaatcaagtcacacccgtaatccctgcattttgaaagaccaaggcaggagtgttgcttgagcccaggagaatgagaccagcctgggcaacatagttagactctgtctctactaaaaattaaagacagaaaacagatactgttatggaaatctaaccaaatatggctgcctgcctaaggctttgtgcattgacaactgctctttcttggttaaagagggaaaatgtcaatggtaggtgttaacatggtagcaactaagtaaaaatttctccttcactcaaaaggattgagagagttggaaaggaagtaactttgttaccttgtttttctgtgttgggctcctgtatcacttaaaagcatctctggtatcccatctgggagttttagatccatagaatgccaggattgagtccaactcctccaacgcttatttctgaaagctggggggaccttaccctagtgacttgacttatgaccttgcctgtaaaatgggaatgatcatggcagtattttggtatgatgggccactggaggcagaaggttgggcaggtccccagcccctcatgctctctgtcaactccaccccacaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcggtgggtctccactttccagcacattcccattggaaccagcaggtgggcaggggggaagtggctagaggcattggccacttgggctcagagactggagaagtgatgagccttggaagtgactcagttgcaaccagcttggatcttgggtagaaagaaaaccggttttagaatttgagtcaccacccagagccacagaatgagtcataagcaaattgattgacctttcagccaccgcctttgtcatgtgagggatattaatacacatccacagttccttacttgaaatcgttacaggcagatgtgtttcaaagttgagaatattttgagattcccatgtgggacatgacaccctcagctgggtctaaggcagccctataatcaaacacaatatttctgccataaaatgtgtaactatttacatcaaatggggtaaataacaagtataaagagcttcatgtccaatcagatcaggtttcattaccaaataagttaggtaagaggccaggtgcagtggctcacacctgtaattccaacactttgggaggctgaggtgggaggatcacttgaggccaggagttggagaccaggttgggcaacataatgagagcccatcctacaaaataaattttaaaagttagcggggcatggtagcacacacctgtagtcccagctacccgggaggctgaggcgggaggattgtttaaacacaggagttcaaggctgcaatgcactatgatggtaccactgcactccagcctgcgtgacagagtgagaccctgcctctcaaaaatatatacatataggccgggcgcagtggctcatgcttataatctcagcactttaggaggccgaggcgggcggatcatgaggtcaggagatcgagaccatcctggctaacacggtgaaaccctgtctctactaaaaatacaaaaacctagctgggcatggtggcagacgcctgtagtcccagctacttgggaggctgagacaggagaatggcgtgaacccgggaggcggagcttgcagtgagcccagattgggccactgtactccagtctgggcaacagagccagactccatctcaaacaaacaaacaaacaaacaacaacaacaaaaatatatatatatatatatgtatatatatatatgtacacgcacacacacatatgtattatatgtgtgtgtgtatatatatgtatgtgtatatatagtgatattgttaccagtgtaaagtggcattttgcaacacatggtagcctgttgttatcttgatggctatttattgaaattaggaggatgccagatgtctggataggagtctggaactaacccttgtttcctgccttgaaaaggagtagcaacctcccttagcctgatgaacctctaaatgtcccctatgtctctctgcctcctcctaaactccctccaccccacccccagcaagcctgaggctctcaccctgaggactagaagttatcacgttggaagagggtgctggaccctgggtcagctctcccaccaggagtaaggttgtgccatcacccatggatttatctcaaagtagatgcacacgtcatcccctatgaagcacaggaacacatggtggcaggatggggagtcactgcttcccaagcagtctaggctggtggaccactcttcctttccctccccctgtctctgataaccaaagacaagtgcaagacagcccctctttcccatttactaacagtccccactctctgtggcagaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacagtaagtggcccgactggaaatctatccaggaggagccctggggagcaggaggataaagggcctgagagcttagcaataagaaaggtcttggaggccgggcatggtggctcacgcctgtaatcccaacactttaggaggccaaggcagatgtatcacttgaggccaggagtttgagatcagcctggccatcatggcaaa

SEQ ID NO: 2678 - DNA, 5481 bp, Homo sapiens
  ENST00000637485
tatatttttagtagacacggggttttgccatttggttaggctggtctcgaactcctgacctcaagtgatctgcctgcctcagcctcccaaagtgctgggattacaggctcgagccaccgtgcccagccggtgtccaccccatgtctagcaccagccagacactgtgccggcgcaccctcatcttcaggcctgggtgacaccagaggtgtgctatggtgtgtcctggacaggggctgggccagaggacattgctcgtccaggcagaaacatcaggcctggggaggggcacaggaaaaatcaacctaccctggcaggggcctggccttgaagcaggaagagatgccgtggcaggaagttggccccagtgtttaaaaaaaccacgtagcaactatttctcgcccaggatgcccaggaaagcaagggtactgggggattagatccatcaccaagaaggatacagtcagccctgaacttctctggggccgcttctaatccactacagggcttggggcaaattttaaaaggtacccttcccgtgggttagcgaactggcctagtacagtgatttttttgttaggatttgctgccatctgctggacaatttcattcacaacatacaaatctgcagtatgaaaagagatgggaggggcccttgtgcagtgcacgccctgcgcaactgtatatagcagctgtgtttcctcttctgggtagaaactctgctccccagtaggcgatcgttagttttaccggggctctgctggaacaggccagtgatccactgctctcttgcttttatcccttacaggtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcacgtaagtctcctcgcaagggttcctcttgcctcttttcccccaacccccagcctgggccacacatcggattacaggacatgttctcagggtctagggatggggtgtgtgggctccggggacgtgggagatatcagcatgccaccaggaagagcttcgatggctttttgcatgatgtccatggaggaagaaggagaagggaccccccctcctgccaaccttctacctcctcacacagcaacgggcctcagccacatcactggccccttgctgtgcagcttcctgtagactagcctcgccggaacatctcatccccctactactccacaagcgccgcccaaaccgctgtctctttggaaagtccctaaagagacaatcaggaaacgaatgtgcatgagaattctgaccccctccctatgcctgaaggccccgtagttgtagacctggtgactccctttgtgtgtctttcacttctcctggcagtcctaggattctctgccctctgaaaggccatgtgtcatcctgcagctccaagatggcgccccagttgtaggcagccatttcaggatggcacccaagctcttagtagtcatcccaagatggcatccaagttctgggtggccattccaagatggcccctgagttctgagctatcattccaagatggcctctgaatttggggtggtcattcttagatggtccctgagttccaaggtgaccttcaagttctgggtagccattccaggatggtccccaagctctgggtggctattccaagatggccccaagttctaggcagccattgcaagatggcccctgagttccagggtggcccccaagttctgggcaaccattccaaggtggcatccaagttctgggtggctattccaagatggcctctgatttctgggctaccatgctaagatggcctctggattcttggtggccattcttacatggtccctgagttccaaggtggccttcaagttctgggtagccattccaagacggtccccaagtcttggatggctactcgaaggtgacccccaagttctgggcagccatctcaaggtggcaccctagttctgggtaaccattccaaaatggcacccaagttctagggcaaccatttcaaaatggcccccaagttctgggtgactatttcaagatggtacccaacaggtgagtggccattagcccttagggccctgatagcagacttagcagtacattcctgaagttgtagacatttggagcgggatgaaaaatatctaatcagtctttaatcaagaaacaaatcttggggaccctggctgtgcccatcatggtgaatgattccctgacaggttttgaaaggatcttgacacattcactcccatcgtgagagaatcaggggcttcctcctgtgcctctgcctctaggctccctcctgagccaatctggaggggcccttgaatggtctccctcaccaaacaatgaggacttggtttgtcaggagggccaaaatagtggcccatttccagtagaagggctgttaagtaggccacacttagattcttctctgggaacacaatgaggtcaagttgtgttagaacaaaaaatctccagagtttttggatgcctcagagctggagatgtatcatgaaggttgggaggctgattatacttctttctctttctctttcactccttcctcctctttctcctctctttttgttcgtttactcttttctttttctcttctcctctccctccccacatccttccctctcctcaaagcttttcagtgtctatttgactactagagcaatgcacggtggcttacacctgcaatcccagcactttgggaggctgagacaggcagattgcttgagcccaggaggccaagaccagcctgggtaacatagggagaccccatctctaaaaaaaaaaaaaaacaattagccaggcatggtagtatgcctgcactagcagctacacgggaggctgaggtgggagaattgcttgagcccaggaggttcaaggctgcagtgagccgaaatcgcaccactgcaccccagtctggggaacacaggaagaacttgtctcaaaaaaataaaaagtttaaaaaattaaaaatcaatgaatttgctatttagaatattatgctttatatggttactgaataattttaatagtgatgagtacaaaaaaaacaggtttagcaagctgttctgtaggttaaaaagtaaataaataaataattaattaaacaaaatacaatgcacatcaaattaggggacaaagattgtgacgaataagacaaggagtccatgtctttaaaatatgaaaagcagttacaaatcaataagaaacactacttctcaatggataaatgggcaaaggacataaacagaaatctgatagaatgctggcaactagtaaaaatggaggtaaatcaacccttggaattcagagaaatgtaaaataaaaacgagatacaattcattccctatcaagttagcactgttcccgccgcacccccacacacacacaaaaaatgatttttttagctaataaacagcatatataagaatgtattataataggctgggcacagtggctcacgcctgtaaccctagcattttgggaggccaagggagggggatcacctgaggtcagcagttcgagaccagcctggccgacatgacaaaaccctgtctctactaaaaaatacaaaaattagccaggcatggtggcggatgcctgtaatcccagctactcaggtgggtaaggcaggagaattgcttggacccaggagatggagactgcagtgagccgagatcatgccactgcactccagcctgggtgagaaagcaagattttgtctcaaaaataaaaaaaggaatgtattataataaaatatacttttctccccctctatcacctatttaagcaggtccttcaagttgtcaggtagacatcatgctatgagaaaatttaaatcctgaaaagccagaatgttttaccaccctcagcctggaatgaatccttctcctatggaaataacctacgggtttctccacccctctctgcctttcagccccttccctccctctcccctccttttctttctccctctttctcttcctcctttcccctctcttccctctctcttcttccctctctctgtctctttctgttcgtctttctccttttaccccctctcagtttctatctttttattttcctctttctctctctctctccctctctttctctctcactccctgcactgttgatgacctatgtccttgggtgatgtgggcctcccctggaccgtgtagcttggagaaagctgaccctctgtcatcggtctggcaacagggacttggcccccctaccctgcattctgatgaggaatggtattcagacaaaggcagatcccaggacacaggaggacatgctcaggcagggacccccgcccctttcctctggggcaaggtctgctcagcagcctccaagattcctagggctcaagaggtggcaggtagctcagggcactagggcaggcagtggggtgaatatgtcactcatatccacctgtccacacacaatgcttaccttggccacctgtgcccaggggaatgggttttatcctgtgaatcctcccagtgaccaccactgagtgtggcacagataaatggtaccaagcccaagctgttcaggtctccaatgtcactttcctctcagacctctgttgtagctgacatactgtaatgctgaggagggccgggcacagtggctcatgcctgtaatcctagctctttcggaggccaaggcagatggatcacctggggtcaggagttcaagaccagcctgggcaacatggtgaaaccccaggcaacatggtaaaaccctgtctctactaaaaatacaaatattagccaagcgtgatagcaggcgcctgtaatctcagctactcgggaggctgaggcagaagaattgcttgaacctgggaagtggaggttgcagtgagccaagattgcaccactgcactccagcctgggcaacagagcaagactctgtctcaaaaaaaaaaaaaaatgctgaggaggtgactgtcccacctccatcctccgagttgaccatcacaatttagggaggggaatgacctacaaaggacccagaagcaagcctttcaattgttgagcttttgccattatgggccatcgtttacaacatgctgtttctaggttctctggaggtaaaattagcctcctcttttaaacaaagctaatctgcaaaagcgaaccaaaaattcttttccaccagagatcaattagcagaatgagctgggtgcgatggctcacacctgtaatcccagcacttggggaggccgaggcaggtggatcacttgaggtcaggggtccaagaccagcatggccaacatggtgaaaccccatctctactaaaaatacaaaaactagctgggtgtggtggggagggcctgtagtcccagctactcgggag

SEQ ID NO: 2679 - DNA, 2840 bp, Homo sapiens
  ENST00000635786
gtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcacgtaagtctcctcgcaagggttcctcttgcctcttttcccccaacccccagcctgggccacacatcggattacaggacatgttctcagggtctagggatggggtgtgtgggctccggggacgtgggagatatcagcatgccaccaggaagagcttcgatggctttttgcatgatgtccatggaggaagaaggagaagggaccccccctcctgccaaccttctacctcctcacacagcaacgggcctcagccacatcactggccccttgctgtgcagcttcctgtagactagcctcgccggaacatctcatccccctactactccacaagcgccgcccaaaccgctgtctctttggaaagtccctaaagagacaatcaggaaacgaatgtgcatgagaattctgaccccctccctatgcctgaaggccccgtagttgtagacctggtgactccctttgtgtgtctttcacttctcctggcagtcctaggattctctgccctctgaaaggccatgtgtcatcctgcagctccaagatggcgccccagttgtaggcagccatttcaggatggcacccaagctcttagtagtcatcccaagatggcatccaagttctgggtggccattccaagatggcccctgagttctgagctatcattccaagatggcctctgaatttggggtggtcattcttagatggtccctgagttccaaggtgaccttcaagttctgggtagccattccaggatggtccccaagctctgggtggctattccaagatggccccaagttctaggcagccattgcaagatggcccctgagttccagggtggcccccaagttctgggcaaccattccaaggtggcatccaagttctgggtggctattccaagatggcctctgatttctgggctaccatgctaagatggcctctggattcttggtggccattcttacatggtccctgagttccaaggtggccttcaagttctgggtagccattccaagacggtccccaagtcttggatggctactcgaaggtgacccccaagttctgggcagccatctcaaggtggcaccctagttctgggtaaccattccaaaatggcacccaagttctagggcaaccatttcaaaatggcccccaagttctgggtgactatttcaagatggtacccaacaggtgagtggccattagcccttagggccctgatagcagacttagcagtacattcctgaagttgtagacatttggagcgggatgaaaaatatctaatcagtctttaatcaagaaacaaatcttggggaccctggctgtgcccatcatggtgaatgattccctgacaggttttgaaaggatcttgacacattcactcccatcgtgagagaatcaggggcttcctcctgtgcctctgcctctaggctccctcctgagccaatctggaggggcccttgaatggtctccctcaccaaacaatgaggacttggtttgtcaggagggccaaaatagtggcccatttccagtagaagggctgttaagtaggccacacttagattcttctctgggaacacaatgaggtcaagttgtgttagaacaaaaaatctccagagtttttggatgcctcagagctggagatgtatcatgaaggttgggaggctgattatacttctttctctttctctttcactccttcctcctctttctcctctctttttgttcgtttactcttttctttttctcttctcctctccctccccacatccttccctctcctcaaagcttttcagtgtctatttgactactagagcaatgcacggtggcttacacctgcaatcccagcactttgggaggctgagacaggcagattgcttgagcccaggaggccaagaccagcctgggtaacatagggagaccccatctctaaaaaaaaaaaaaaacaattagccaggcatggtagtatgcctgcactagcagctacacgggaggctgaggtgggagaattgcttgagcccaggaggttcaaggctgcagtgagccgaaatcgcaccactgcaccccagtctggggaacacaggaagaacttgtctcaaaaaaataaaaagtttaaaaaattaaaaatcaatgaatttgctatttagaatattatgctttatatggttactgaataattttaatagtgatgagtacaaaaaaaacaggtttagcaagctgttctgtaggttaaaaagtaaataaataaataattaattaaacaaaatacaatgcacatcaaattaggggacaaagattgtgacgaataagacaaggagtccatgtctttaaaatatgaaaagcagttacaaatcaataagaaac

SEQ ID NO: 2680 - DNA, 3381 bp, Homo sapiens
  ENST00000637774
tggatagactatttaggggagaaatttatcccatgaatgtcgtagtggctcggaggttgttttagaattgaatgtctcccagggatatttcttgaaagcctgaccgctcaaaatgcttcttgacaatgaaggatcatgtcagataagatgggggagaagctgctttctataatctgcctcttggcaactcaccctgggtagtaataaataaaagtacctttaaagtacttttttatttagttgacttatcgattttactaaggaaacacttatgtggtatctactcagtgccaggcactgttctgagtgccttaaaattttttttaatttctctgaggttgttactatgcttagctccatttgacagatgaaaaaactgaggtccagagacgtgaattcacctgcccaaggtcacacagcaagccagtgggagagctggagtttgagcccagacactggctctagcctccttgttcttaaccactcagctctgctgccattcacacaaccttatgaactatttattattggctccacttattaagaggttaactggcacatcccattggcacattcaaggctctgataaggcctgcaattcataatttcaataactaactttttggagcccctatcatgagccaggcataaattaagtcttgggtctcatgattttgtgaagtaagcactagtattacggctattttacagatgagggcaccaaggcacagaggggacaagtaacttgcccaaggtcacacagctaatttttaaaaagaaagaaagaaatctacttaacccatagattcacaatattgtttggccctgggacatttaatatcgaaaagcctttttatctcctacagaattaaggaccgtatttcttcaacctagcttggggatcaagatacttcaagagggtcgtttgggagtgataggaactttgctaaacagggcatgtgaatgtcttctctcaccgaggtcccctctgccttcttggggttccaggacccagagagggcccccacctggaggagtttaatagtttgttgtgtaggaggccttgggggttggagatctcagtagtggtaggtaacatgagattatggaagaaaagggtttgtgagcctgtggtctgagtggacctctgcacgcccatctgtctccaacagccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcacgtaagtctcctcgcaagggttcctcttgcctcttttcccccaacccccagcctgggccacacatcggattacaggacatgttctcagggtctagggatggggtgtgtgggctccggggacgtgggagatatcagcatgccaccaggaagagcttcgatggctttttgcatgatgtccatggaggaagaaggagaagggaccccccctcctgccaaccttctacctcctcacacagcaacgggcctcagccacatcactggccccttgctgtgcagcttcctgtagactagcctcgccggaacatctcatccccctactactccacaagcgccgcccaaaccgctgtctctttggaaagtccctaaagagacaatcaggaaacgaatgtgcatgagaattctgaccccctccctatgcctgaaggccccgtagttgtagacctggtgactccctttgtgtgtctttcacttctcctggcagtcctaggattctctgccctctgaaaggccatgtgtcatcctgcagctccaagatggcgccccagttgtaggcagccatttcaggatggcacccaagctcttagtagtcatcccaagatggcatccaagttctgggtggccattccaagatggcccctgagttctgagctatcattccaagatggcctctgaatttggggtggtcattcttagatggtccctgagttccaaggtgaccttcaagttctgggtagccattccaggatggtccccaagctctgggtggctattccaagatggccccaagttctaggcagccattgcaagatggcccctgagttccagggtggcccccaagttctgggcaaccattccaaggtggcatccaagttctgggtggctattccaagatggcctctgatttctgggctaccatgctaagatggcctctggattcttggtggccattcttacatggtccctgagttccaaggtggccttcaagttctgggtagccattccaagacggtccccaagtcttggatggctactcgaaggtgacccccaagttctgggcagccatctcaaggtggcaccctagttctgggtaaccattccaaaatggcacccaagttctagggcaaccatttcaaaatggcccccaagttctgggtgactatttcaagatggtacccaacaggtgagtggccattagcccttagggccctgatagcagacttagcagtacattcctgaagttgtagacatttggagcgggatgaaaaatatctaatcagtctttaatcaagaaacaaatcttggggaccctggctgtgcccatcatggtgaatgattccctgacaggttttgaaaggatcttgacacattcactcccatcgtgagagaatcaggggcttcctcctgtgcctctgcctctaggctccctcctgagccaatctggaggggcccttgaatggtctccctcaccaaacaatgaggacttggtttgtcaggagggccaaaatagtggcccatttccagtagaagggctgttaagtaggccacacttagattcttctctgggaacacaatgaggtcaagttgtgttagaacaaaaaatctccagagtttttggatgcctcagagctggagatgtatcatgaaggttgggaggctgattatacttctttctctttctctttcactccttcctcctctttctcctctctttttgttcgtttactcttttctttttctcttctcctctccctccccacatccttccctctcctcaaagcttttcagtgtctatttgactactagagcaatgcacggtggcttacacctgcaatcccagcactttgggaggctgagacaggcagattgcttgagcccaggaggccaagaccagcctgggtaacatagggagaccc

SEQ ID NO: 2681 - DNA, 1887 bp, Homo sapiens
  ENST00000637966
cagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagggactggctagtgctggaccgggcagtccctccagagtcagcaag

SEQ ID NO: 2682 - DNA, 1124 bp, Homo sapiens
  ENST00000637117
ggtggggcacacctgtaatcccagctactcaagaggctgaggtgggaggatcacttaagcccaggaggacagtgctgcagtgagctatgattgcgccactgcactccagcctgggtgacacagtgagacccggtctctatagataaatgaatggatgaatgagggggtcaaggatcctcacccggcttccatttggagggaggagtttggttgagttcttgcaaggttggtacctaggaaatgcttgccagttctggagcccagacactgtccctggacatgagaccaggttctctgccctaggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcaggtacagcctccacctggccccacgggccaacacctctcagtgtcacagatgaaagtgcctgctccacatccaaggggcttccctgaactcctccttctctacctggccttttcacaccactttgaaacacagattttatggttatcattattcaattatggtgaggccaacagatcaggagatgaatgtcattggaaagatagtttgtggctgggcacggtggctcacacccataatcccagcactttggccaggtacggtggctcacacctgtaatcccaacgctttgggaagcccaggtgggcggatcacttgagatcaggaattcgagaccagcctggccaacatggtgaaaccccatctctactaaaaatacaaaaattagccgggcgtggtagcacatgcctgtaatcccagctactcgggagatgaggcacaagaattgcttgaacctgggaggcagaggttgcagtgagccaagatcgcgccactgcactccagcc

SEQ ID NO: 2683 - DNA, 1783 bp, Homo sapiens
  ENST00000636974
cgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcaggtacagcctccacctggccccacgggccaacacctctcagtgtcacagatgaaagtgcctgctccacatccaaggggcttccctgaactcctccttctctacctggccttttcacaccactttgaaacacagattttatggttatcattattcaattatggtgaggccaacagatcaggagatgaatgtcattggaaagatagtttgtggctgggcacggtggctcacacccataatcccagcactttggccaggtacggtggctcacacctgtaatcccaacgctttgggaagcccaggtgggcggatcacttgagatcaggaattcgagaccagcctggccaacatggtgaaaccccatctctactaaaaatacaaaaattagccgggcgtggtagcacatgcctgtaatcccagctactcgggagatgaggc

SEQ ID NO: 2684 - DNA, 552 bp, Homo sapiens
  ENST00000636022
gcggcaacaacagattgaacgtgagctcaatgggtacatggagtggatctcaaaagcagaagaggtgatcctcgccgaggatgaaactgacggggagcagaggcatccctttgatgttggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggtaagtgctcttgtttc

SEQ ID NO: 2685 - DNA, 1890 bp, Homo sapiens
  ENST00000637625
ctctccgacttcctttgtgagtatcacccagccccacccctgccaactccctgatccctccctcacaccctttttccacttctctttctctggtagtatgtgtatcttctttggtcctcattgaatctgccctttcctttagccatttctataactgtcactggggccaatgttactgttgctatgacaatggaacccatctcccttagacctgagagctggaagctggaattcagaccaacaaatgctcctgtgattcctttctaagagagagggacagaggggtgctggtgaaggggatgttggaagagagacagagaaagacggagctcataagatagacagatagaaacagaaacatacatgtattaataatttttatgtacatctctggaaatgttcataacttatggttaagagaggatgccttagaaataaggagtggcttatatgttgccctcattttctctacttatttctgactctacttctctcttctttcaaaccttctgcttctttcctgttaggttggtgcaaaattaattgcgttttttgccttttttttttttttttttaaccacagttacttttgcaccaacctaatacttcctcccctgccctttttggcttccttattcattcatagaacatcccctccagtatctgcgagagcgttttgctccctcaaggtacaaggcccactaaggctttgccctctgggcctattcccagattctatgtgagttagcatgagatagtatcaaaattgagggccaagtgagggtgaggaaaagcagcaaaagatggggagatgtctgagcaggatttaaaaagtaaagagctcgaggaatcaacaagagcagcgactggggccaggcatggtggctcacacctgtaatcccagcattttgggaggctgaggtgggtggatcacttgaggccaggagttcaagaccagcctggccaatatggtgaaaccctgtctttacaaaaaatacaaaaattagccagatgtgatggtgcacacctgtaatcccagctactcaggaggctgaggcactagaactgcttgaatccaggaggcagaggttgcagtgagccaagatcatgccactgcactccagcctgagcaacagagagagtgtctgtctcaaaaaataaagtaaaataaaataaaataaaataaagagtagtgattgggcagtgaggggggcaggtggatgccctggctttggctcacaggccccaagtaaggacttctcaaaacgtcttttgcctactggctgtctaatttattcactgaccttctgacctggttcagaattgacttaggacagcaagaagagacagtctagtctttgacctagaaaggcccgtgagcctagtccaggccattgtcttcttataaccctccttgttcccagtcacgttggctgaccccccaggacacccctcaggaaccagttctccttcccagggccctgacctagtttcaaacttagtaattgtttttagtccctctggagtctcttataaatgaggactctacttcgtgttttaacttcctctaatactctatttttaatctcctatattctctctactaatcatcttgtacagtctgtcctggttcaggaacaagggactgagacttcctgcctgggtcctcagtgtctataaaggtcctttactcattcccactttccctttgagaaaactgagacacagagaggttaagtagattgcccaggatcacacattagcttggcatgatggcgggcgcctgtaatcccagctacttgggaggctgaggcaggagaatcgcttgaacctgggaggcagaggttgcagtgagcccagatcatgccactgcactctagcctgggcaac

SEQ ID NO: 2686 - DNA, 1651 bp, Homo sapiens
  ENST00000593160
gaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcaggtgaggccctttcatcctggggcccagggatggagatcccaggccacggagtacaaagagagtcatgcagtttggagaaggctaagctgggagggttatgatgggaggagaaagagaacctgaattggtagtcccaaattttatcaacaagaatccagagtctgatatgaagaagtctaagatgaagccaggatctgacatcacgtaacttgaattctgaaatcagacgctggtttacatcccggccctgccactttttacccatgcaccacacatccctgtacctccgtttcctcagctgttacatggaggcgatggtagtgcctaagtcatagtactattggagtatttagtaaaataatctcagctgagtcacttggggagagaagtgcctgatacacggtaggcacatatttatttgttcagccatttaacaaacatttagggagcacctgctgtgtgccaggcactgatctaagcactgaggatatgggagtaaacaatacacaccaaatccctgccctcagagctctgatattctaatgagagagataaagcaaacaaatacatgtcatgttgggaactcccaaattcagagaaggaagataaaacagactaggaagataaaacagagtaggaagttggccgggcgcggtggctcacgcctgtaatcccagcactttgggaggctaaggcgggcagatttcctgaggtcaggcattcgagaccagcctggcc

SEQ ID NO: 2687 - DNA, 3938 bp, Homo sapiens
  ENST00000636966
agggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacaggtaggtccacggagcatgatgcatctttccagttttctccttcagggacaagctcttgggaggattaggcaggggtgtgcttctttctcctggcagctgggaggaccgtctccttcagagagcactacaggagaggcagtgagtgaaatagcctctgagatcttagctgttgaaaggggtggggttccacagaaggtgacccagcagagaaagagtttatttgggaatgatcccaggaagcaccatcgggggaatgaggaagtgagcagagaaagaagggatcttttaaagagtgtgctatcaagcgggttaccacttaaaactgggactggatccccctgggcacctctgggagacagcaaagaacacacaactcagctggtcacggtggctcacgcctgtaatcccagcactttggggggccaaggcgggtggatcacctgagatcaggagtcagagaccatcctggccaacatggtgaaaccccatctgtactaaaaaatacaaaaattagctgggtgtggtggcaggcacctgtagtcccaattactcaggaggctgaggcaggagaatcacttgaacccgggaggcagaagttgcagtgagccaagatcacaccactgcactccagcctggcgaaagagtgagactccatctcaaataaataaataaataaaaatataaataaaaaaagaacacacacctcagagccgtcccagccaaggggcaagggagctggggtatttatacactggcttctttttgacattggtgaggactgctcctagagtgggaattaatgcctggcacatctggctgagtggaacaggtattctgggtgctttcagacctcgaccagtcctgacttctaaagcaagcaagaagtggggagagttgggccagaaaagggttattgcctcaatgcattgtgagtggtaccttgtggaaggtgagagacagagaagattccaggcacaggtgccatgctaaacgatagttctcatttattataggaacccatggatttattttgttctctgccctgagtgctgggtgagagtactggatgagtcctcctggtctcccccaacccccaggatgtaccagagataccccaattgggagtcctggcaccaaccaatcagaacctagcactcagcagcattctgcccctccctgactatgcccacattaacccttcagtggctgggtctgggggtagggtgagccccggaaaagccaggcagcgcagagacactctcccagggctcagctctgaaccagcagtgtggaagcagtgtgtccaccacgatccacactcaggaaccaaatagcccttggatacgttttcagttaaatctttgccatccaaactctagctgcttgctctctaaagctccagaatgaaatggaatcaagtaggaagggatgccttcagtatttcagtatttggaccactggccatctgggtgcagacagactgaatagcagttctggttctgatgatttgggtcaagggagctgtgaattgaaggagtggatagaaggaatcaagaagcccaaaggggaacccaggtgggcagagaaagaggtttcaggccccttatttgggaaaggcagccacagaagaagattctgtctgggagtggatttccacccaccctctccacccagtgacccccaagtggatccgcagaggcagcccctgagccctccctccccactcctccccacggggagggaaaacccactggggaaggtttatttgcaatggttggaggtttgggtttttttgtgggttttggtttgttggttttttttttcctctttttctcttgctcctcctgtctctttctctcctgggcttgtgaagtttgctcaatatggaatgtcctaattatttctttccccgatgaagaaggtgttaattgaggcagagctatttctgctcctggcctcgtcacccaggcggaaatgcgagagagagagagagagagagagagaatgaatatggggcagggcctcttggaaaaatcagccgtgagcagagaaaccaggactcctggatcctaggtttctgtgaagttttattttatgtttttctaccctagactagctaaaggagaagaggccatggggttggcttgggtccgagtggggttttgaggggacagatgtgggtggtgccaccagaggggaggaagcctcgatttaggagaaagactgaaaagctagctcacgattaaaaatataagacgtgtgagtaagagacagatatatacagacacccaggcagtgggttaattttaaaatgtatttataaccgaattcctcagacactctggacgcttgtttttctagaagcaacgctcagagtgtttcgtgtcggtggttggggggttgagggggattgcaaagctgctaaagatagacccgttttcagtagcattcctcagtgtcgggagcccagttcctgtgtgcccagcaccgtgccaatcgcttagaaggaagcaaagataaagtggaaggcttcctgctttctaagagcttccaaaatagttagaggaaacaagacccctcatttgcagccatttttaacagtgaaggctaatgtgtgattatacccacgcccccctaaatatgaaaattcagtagctattgtatgcctgaaaggggccaggtgcagtggctcacacctgtaatcccagcactttgagaggctgaggtgggagtatcccttgaggccgttagtttgagaccagcctaggcaacatagccagaccctgtctctgctaaaataaaaatttaaaaattggccgggtgcagtggctcacgcctgtaatcccagcactttgggaggccgaggcaggcggatcaaaaggtcaggagttcaagaccagcctggccaacatagtgaaaccccgtctctactaaaaatacaaaaaaaataaattagccgggcatggtggcgtgtgcctgtagtaccacatacttgagaggctgaggcaggagaatcacttgaacctgggacatagaggttacagtgagccgagatcacgctactgcactccagcttgggcaacagagtgagattttgtctcaaaataaaaaaatttaaaaattagccatgagtggtggtacatgcctatagtcctagctactcaggaggctgaggaagaaggatcacttgagcccaggaattggaggctgcaaggctgcagtaagctatgatggtgcccgcactccagcctgggtgacaaagtgag

SEQ ID NO: 2688 - DNA, 3894 bp, Homo sapiens
  ENST00000637952
tactttaaagttaaaagtgctttttaaaaaataataaggccaggcgtggagactcacgtctgtaatcccagaactttggaagaccgaggcgggtggatcacgaggtcaggagatcgagaccatcctggctaacacggtgaaaccctgtctccactaaaaatatgaaaaattagctgggcctactcgggaggctgaggcaggagaatggcgtaaacctgggaggcggagcttgcagtgagccgagatggcaccactgcactccagcctgggcgatataacaagactctgtctcaaaaaaaataaataaaataaataataataataataggggccaggtatggtggctcacacctataatcctagcactttaggaggctgaggagtttgagtccttggagaccaggggtttcaggccagcctgggcaacatagcaagaccccatctctacaaacaagttttaaaacttagccaggcatggtggtgcatgcctgtagtcctagctattgcagggactgaggcaggaggatcacctgagcccaggaggttgaggctgcagtgagctgtgattgtgccactgcactccagcctgggcagcagtgcaaaaccctgtctcaaaggaaaaaaaaaacctaggaagtgttgttcccatgataaggatcagcctccgtgtggtgcttccttcaccattgcccaatccccaggctcctgggtgcttaatgttccctcaggaacacacctgctttgtctgggagagacctgggcgtcttggtggcggggtttgggggtacttgctcatgggcttatggggcctctctctgtgtccccccaggtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacaggtaggtccacggagcatgatgcatctttccagttttctccttcagggacaagctcttgggaggattaggcaggggtgtgcttctttctcctggcagctgggaggaccgtctccttcagagagcactacaggagaggcagtgagtgaaatagcctctgagatcttagctgttgaaaggggtggggttccacagaaggtgacccagcagagaaagagtttatttgggaatgatcccaggaagcaccatcgggggaatgaggaagtgagcagagaaagaagggatcttttaaagagtgtgctatcaagcgggttaccacttaaaactgggactggatccccctgggcacctctgggagacagcaaagaacacacaactcagctggtcacggtggctcacgcctgtaatcccagcactttggggggccaaggcgggtggatcacctgagatcaggagtcagagaccatcctggccaacatggtgaaaccccatctgtactaaaaaatacaaaaattagctgggtgtggtggcaggcacctgtagtcccaattactcaggaggctgaggcaggagaatcacttgaacccgggaggcagaagttgcagtgagccaagatcacaccactgcactccagcctggcgaaagagtgagactccatctcaaataaataaataaataaaaatataaataaaaaaagaacacacacctcagagccgtcccagccaaggggcaagggagctggggtatttatacactggcttctttttgacattggtgaggactgctcctagagtgggaattaatgcctggcacatctggctgagtggaacaggtattctgggtgctttcagacctcgaccagtcctgacttctaaagcaagcaagaagtggggagagttgggccagaaaagggttattgcctcaatgcattgtgagtggtaccttgtggaaggtgagagacagagaagattccaggcacaggtgccatgctaaacgatagttctcatttattataggaacccatggatttattttgttctctgccctgagtgctgggtgagagtactggatgagtcctcctggtctcccccaacccccaggatgtaccagagataccccaattgggagtcctggcaccaaccaatcagaacctagcactcagcagcattctgcccctccctgactatgcccacattaacccttcagtggctgggtctgggggtagggtgagccccggaaaagccaggcagcgcagagacactctcccagggctcagctctgaaccagcagtgtggaagcagtgtgtccaccacgatccacactcaggaaccaaatagcccttggatacgttttcagttaaatctttgccatccaaactctagctgcttgctctctaaagctccagaatgaaatggaatcaagtaggaagggatgccttcagtatttcagtatttggaccactggccatctgggtgcagacagactgaatagcagttctggttctgatgatttgggtcaagggagctgtgaattgaaggagtggatagaaggaatcaagaagcccaaaggggaacccaggtgggcagagaaagaggtttcaggccccttatttgggaaaggcagccacagaagaagattctgtctgggagtggatttccacccaccctctccacccagtgacccccaagtggatccgcagaggcagcccctgagccctccctccccactcctccccacggggagggaaaacccactggggaaggtttatttgcaatggttggaggtttgggtttttttgtgggttttggtttgttggttttttttttcctctttttctcttgctcctcctgtctctttctctcctgggcttgtgaagtttgctcaatatggaatgtcctaattatttctttccccgatgaagaaggtgttaattgaggcagagctatttctgctcctggcctcgtcacccaggcggaaatgcgagagagagagagagagagagagagaatgaatatggggcagggcctcttggaaaaatcagccgtgagcagagaaaccaggactcctggatcctaggtttctgtgaagttttattttatgtttttctaccctagactagctaaaggagaagaggccatggggttggcttgggtccgagtggggttttgaggggacagatgtgggtggtgccaccagaggggaggaagcctcgatttaggagaaagactgaaaagctagctcacgattaaaaatataagacgtgtgagtaagagacagatatatacagacacccaggcagtgggttaattttaaaatgtatttataaccgaattcctcagacactctggacgcttgtttttctagaagcaacgctcagagtgtttcgtgtcggtggttggggggttgagggggattgcaaagctgctaaagatagacccgttttcagtagcattcctcagtgtcgggagcccagttcctgtgtgcccagcaccgtgccaatcgcttagaaggaagcaaagataaagtggaaggcttcctgctttctaagagcttccaaaatagttagaggaaacaagacccctcatttgcagccatttttaacagtgaaggctaatgtgtgattatacccacgcccccctaaatatgaaaattcagtagctattgtatgcctgaaaggggccaggtgcagtggctcacacctgtaatcccagcactttgagaggctgaggtgggagtatcccttgaggccgttagtttgagaccagcctaggcaacatagccagaccctgtctctgctaaaataaaaatttaaaaattggccgggtgcagtggctcacgcctgtaatcccagcactttgggaggccgaggcaggcggatcaaaaggtcaggagttcaagaccagcctggccaacat

SEQ ID NO: 2689 - DNA, 1346 bp, Homo sapiens
  ENST00000637981
ctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtgcgtgagtttccgaccctgacaaggggtttgctcacgggccccaggagccctcagtttcccctatgcagagcatctcaggaggccacatcctgccaccagcctgtgtgagggcagtctcttctttgggactccctatagggaaccccctaggaatatgactgtagctccccatgagctcctgaaagcaaactaggagccacacccatttattgagcacctactgtctatcgggagccatgctaagcaccacgtgtgatctcattcagtactcacagccctatgaagttgataggactgatgtctctattttatggagggggaaactgaggctcagagtggctgaaacattggagcagggttttgtggctgagaagtggcagaactaggagtgagcaagtgtgactccaagcctgggccgtaccactggtggcaatgaccattcccatttaatgagtgcctgctgcgtgcagggcactacagaaggactttacatgaattaccttatttcatcctcacagtcacccagcgaacacccattttacagatgagacggttgaggcttaaggaggttaaattactcacctgaattcttagagtggacagtaatgagctctaaaattcatactcattccttgctgctttctcattctccacagatacatctagtccccgtttaagggtggctgccatatgcagggtcaagattaagtgtaggttgagccaaaaaaaaatgtaaaaagcaaaaataaaacagggctgtcctttttctatcttcttgtcttggttaataataataatttagccaggcatggtggctcatgcctgtaattccagcactttgggaggatcacttgaggccacaagttcgagaccagcctgggcaacattgtgagg

SEQ ID NO: 2690 - DNA, 903 bp, Homo sapiens
  ENST00000574974
gatcagccaagcaggctgctgagaaagatgacctgaattgcagggatgcagaaagtgctgaagatgctttgtcagctgagaactggttaagagaaagtggctgatacagcaaccccgttcagtgtctgcttttgtggggagccctctgctcagaaaactgctcttcttggcacccacttttctccctcctgtctctgggccacccttcttctttccactgggtgggccatggatgcatggacttcagatagctcggacccctgggtgctgacgagatgggaccctcgggacccctggaggactcgcagtgctgaccactagccgcgtcgcctgagccccagcgctgatgcgatacagtttccccctcactgtgctggagggagaagaccctgggatttctgagcgaggcccgtggatgttgaagtcttcctgggtccccgactccatgctctcgcgccccagttactatgacgccctgcacaaccgcagctcggggcacgcccagcgccctgcaggacactcggcctccccggctcagcatctgcttcgagggcccccctctgaggcggcggggcggcgtggtggatcaccgagatgtcatcttggcccaccaggcccacaaaatccacagcaccccccaggccaggaggaaagaatgggaccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttggg

SEQ ID NO: 2691 - DNA, 3081 bp, Homo sapiens
  ENST00000637616
tttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacggggtaagtggcgcgtgctatacgctttggatttaactagctgaaggattacgaggcttttggttggtgtggtccgggccaggctcaggaaggctgagcccttgtgttctccctccccttgttatgcgcctgcctcctttctgccaacaccccacctccatgtctcagctgtatattacagcagatgctttctgttacaattaaaataatagctcattattgttggctgcttccagagtgctttatgcccattctctaatttaatccttgcaacaacccactgaattaggaaatattaatattcccatctgaccactgaggaatcagaaactcagagtgtaacttgcttaaggccacccagcaagtaagtgatggaactgggagatgaacagaagattatgcattccagaactcaaggttttaagtgttgtacgtgcatgggtctcttgatttgcttgaggatatcttgcttttatttcaacttggtgaatgttttttgagaatgtctgggtgcaagggattgtgattatgacaaaggagaaaagcaagctaaataaggtacagttactgtcttcaaggagttttcagatccatatatgatgaactgtggttgaaatgtgtatatgctttcctctaagcaccctgtatgaggtagcacttgctggtataacaaaagatccaaagctaggaaatgacttaaacacggcagaagtttatttgtcactcatagaaaattcaaaattgagctgggtgtggtggtgcatgcctgtaatctcagcactttgggaggctgaggtgggaggatcacttgagctcaggagttcaagaccagcttgggcaacacagtgagaccacccccccatctgtaaaacataaaataaaataaaaattaaccaggcatggtggtacatgcctgggagaattgcttgagctcaggagttggagggcacagtgagctatgatcatccaaccgtgctccagcctgggcaacagagcaagaccccatctcgaaaaaaaaaagtccaaaataattgttcctagttgacaggctcatctcctccaatgactgacggaccctgacccttgccatattgtggctcttcattgtcagcccacatcatccaataactccatgcttgtctgtatcaaaccaggaaggagaagtgagcatagaaggtgatacttggaaaggtttatgagtttggaaggggtgtgacccatacctgttccattcatatcctattggctagaactcggtcacatgaccacacatcactgcaagggaagctgggaagtatcagattgtgcttagaagaaaagggaaatggatttggagaatgacctactagtctgtcagggaccttaaaaacttttattagattccagtagggacattagtatctggtaccaatggctggttcctcctcttcccactctctactctcctctcagctaagtctgggctcttctattctaagacccttcttcactggacacctttttcatagtaatcatttacaggatcatagctttccatgttttgttgctgctccaggttctgtctctcttggcggatgtgatgggttgcagcacccacactgtgctggccgggctctcacaatgcagatttgtttcagagcaatgttgcctctcacagaaggagctgtggcctattgggctgtttctgtagaggccttcagatgtcagcagtctgttgtaaggactctgggctagctctcatgggcttgggtgttcacagagggatctttgttggctgtgctcacagttcggtggcttgggaccttggtgggttccaagggcatattatggtactgggcacttttctcttagtctactaggaaactcatctagaaacagcctagtggctaacttttttattgtttaaaaaatgtaaagctgggcagggtggctcatgcctgtatcccagcacattgggaggccaaggtgggaggattgcttgggcccaggagtttgagacgagcctgagcaacatagcaagaccacatctccacaaaataaaaattaaaagtgtataaagctgggtacagtggcacatgcctgtaaccccaattactcaggaggctggagagagaggattgcttgagcctaactagtttgagaccagcttgggtaacctagcaagatcccatgcaaaactaagtagagaataatagagcaaacacctgtgtatacattcatttattcaatgactatttattgaacacttctgtgtgccaggtcctgttctaggctctgggacacagcagtaaacaaaatagaaaaatcccctgtcctcatggagctgagagtctactgatggagatggacacaattgatgaatgaatctagtgtgtcagatggcggtgaggggtacagaggaaaaataaagcaggggagggatgggatgtgtggcaggcaggggtgaggggtgctggaagccagggaagacttcactgggcatgtgacatctgaatgaaaacctaagggaggtgagtgagtgagccatgaggagagct

SEQ ID NO: 2692 - DNA, 1623 bp, Homo sapiens
  ENST00000592864
gtggaagagagagaatactcttcttaccaccgttcctctgctctttaagggaagcccgaacggggggaaaaagtctcctttttgagacaacagttttgccctgtgctgggaggtcccagtgcggtgttaaggggcatagagaagagagcaagaaatcgtgaattatttttccccctgaggagcagtggcctggcttgttctcagcttctgccttgcctggattgatctccccaggctgggtccccgtgtagcacttagctaaagatgatcagcagctgagaacgatcggtcctcctttccctcctcccagcatcagggaaacctcctcctcctctttttttttttcccttggcagctgatacagcaaccccgttcagtgtctgcttttgtggggagccctctgctcagaaaactgctcttcttggcacccacttttctccctcctgtctctgggccacccttcttctttccactgggtgggccatggatgcatggacttcagatagctcggacccctgggtgctgacgagatgggaccctcgggacccctggaggactcgcagtgctgaccactagccgcgtcgcctgagccccagcgctgatgcgatacagtttccccctcactgtgctggagggagaagaccctgggatttctgagcgaggcccgtggatgttgaagtcttcctgggtccccgactccatgctctcgcgccccagttactatgacgccctgcacaaccgcagctcggggcacgcccagcgccctgcaggacactcggcctccccggctcagcatctgcttcgagggcccccctctgaggcggcggggcggcgtggtggatcaccgagatgtcatcttggcccaccaggcccacaaaatccacagcaccccccaggccaggaggaaagaatgggagaagctaccagaggatgtgcttcacccaaacaagggagtaaaccaagaagagggaaacagagaacactggacttaagaaatccaacaatgagaagcaaagggaatctcctggatgatgataaagagagagcccaggatgaaagctgtatgccagggaaagtcctgattagaccatgtgacaagtcttcaggaaagactgcttctggatgataaaatgaactgaatacctgttaagagacttggggggtcaaatttgcaataagtaccaaacaaagaagattaaaaaatgataagtcccaagggaaacaatatgttgtaaagaaaaagtagctatagtttgttcatgacataactgtaacttgccttgtacatgataatataaacaccgaatcttcctcactttgtgaaagaacaatattgggcaaatgcgcaggttttggaaagttccatgtgtagggggatggagggagaaattagcaaaatcctccttttctatagctaatacctataaagtgctacaacacccagacaggatacttctttgttgctttcattataatatccttgggtattgctgttggctatttcttaatactacttaaatattcacaagtgtacgacttgttttcccaacctaactataagctctttgatagttaatgcttctctatattatctgtagtggctggcatagtatgctacgcata

SEQ ID NO: 2693 - DNA, 673 bp, Homo sapiens
  ENST00000587451
atatacaagaaatcaggagtaagaatgcttcaaacttcccaacagcaatactggaattgagaatacgttggagcaatacttcacatttttgaagtaaaatgatctccaaaccagaattctatacccagccaaactaccaatgaggaagctaccagaggatgtgcttcacccaaacaagggagtaaaccaagaagagggaaacagagaacactggacttaagaaatccaacaatgagaagcaaagggaatctcctggatgatgataaagagagagcccaggatgaaagctgtatgccagggaaagtcctgattagaccatgtgacaagtcttcaggaaagactgcttctggatgataaaatgaactgaatacctgttaagagacttggggggtcaaatttgcaataagtaccaaacaaagaagattaaaaaatgataagtcccaagggaaacaatatgttgtaaagaaaaagtagctatagtttgttcatgacataactgtaacttgccttgtacatgataatataaacaccgaatcttcctcactttgtgaaagaacaatattgggcaaatgcgcaggttttggaaagttccatgtgtagggggatggagggagaaattagcaaaatcctccttttctatagctaatacctataaagtgctacaacacccaga

SEQ ID NO: 2694 - DNA, 8410 bp, Homo sapiens
  ENST00000614285
atggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggccaccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggtggaggcggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaatccgaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 2695 - DNA, 7158 bp, Homo sapiens
  ENST00000277551
gcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgtt

SEQ ID NO: 2696 - DNA, 9790 bp, Homo sapiens
  ENST00000371372
gcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccca

SEQ ID NO: 2697 - DNA, 9758 bp, Homo sapiens
  ENST00000371363
gggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccca

SEQ ID NO: 2698 - DNA, 9642 bp, Homo sapiens
  ENST00000371357
atggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgcagtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccca

SEQ ID NO: 2699 - DNA, 492 bp, Homo sapiens
  ENST00000413253
caacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgttgccggattcattataaggatatgtacagtttgttgcgttgtattgcgccacccgttggcttagggaagaactgccctcgtaggttggcctacaagcgcctggttcgcatgaacatgcccatctccaacgaggacatgactgttcacttcacgtccacgctgatggccctcatccg

SEQ ID NO: 2700 - DNA, 7158 bp, Homo sapiens
  ENST00000277549
gcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggtaaagaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgtt

SEQ ID NO: 2701 - DNA, 9647 bp, Homo sapiens
  ENST00000371355
atggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggccaccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgcagtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccc

SEQ ID NO: 2702 - DNA, 6856 bp, Homo sapiens
  ENST00000637424
ctgcctttcttcaggctaagaaagaagtactgcactgaattcaaagatatcaaagaatgaatcacggaaattttcttgttgtttatgaattcctctttcagtgtggagggagaactcacatttttggattggacaaattgtaaacttatcttgtaaggaaatttcttgcgctgtgctttaaaagtctgaagatttgctccaaatgccaacagccacctaccatctctactgttctgagacttgcccttgaactgagaaaggacaagcagagagacaaaaaaagcacacactacagcatttcttctactaaaactttccatttggcagtggcattttcaacactatggaaatgaacctccctactttttctagtgatctaattttcattaaaagcactatgtatcaagagatcgatgcccgatataaaggaaaagtgataagtgaagcagaaacgaaggggtacttctctctggcttttggagaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctgtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtag

SEQ ID NO: 2703 - DNA, 7636 bp, Homo sapiens
  ENST00000350061
gggcgagcgcctccgtccccggatgtgagctccggctgcccgcggtcccgagccagcggcggcgcgggcggcggcggcgggcaccgggcaccgcggcgggcgggcagacgggcgggcatggggggagcgccgagcggccccggcggccgggccggcatcaccgcggcgtctctccgctagaggaggggacaagccagttctcctttgcagcaaaaaattacatgtatatattattaagataatatatacattggattttatttttttaaaaagtttattttgctccatttttgaaaaagagagagcttgggtggcgagcggttttttttttaaatcaattatccttattttctgttatttgtccccgtccctccccacccccctgctgaagcgagaataagggcagggaccgcggctcctacctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactggatgaatgatgctatgggatttgaattgccctgggtgtattttgtcagtctcgtcatctttgggtcatttttcgtactaaatcttgtacttggtgtattgagcggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctgtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcac

SEQ ID NO: 2704 - DNA, 6868 bp, Homo sapiens
  ENST00000636938
ccggatgtgagctccggctgcccgcggtcccgagccagcggcggcgcgggcggcggcggcgggcaccgggcaccgcggcgggcgggcagacgggcgggcatggggggagcgccgagcggccccggcggccgggccggcatcaccgcggcgtctctccgctagaggaggggacaagccagttctcctttgcagcaaaaaattacatgtatatattattaagataatatatacattggattttatttttttaaaaagtttattttgctccatttttgaaaaagagagagcttgggtggcgagcggttttttttttaaatcaattatccttattttctgttatttgtccccgtccctccccacccccctgctgaagcgagaataagggcagggaccgcggctcctacctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctgtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacagatgcttgaacggatgctttagaattttctgcctgagctacggcaccaagctggttagtcggaaggcgtttgtggctaaggccttgaaagggaaaagtctcaagtgggcttatttctactgaaacagcatttcagaagaaatgcaggaaaaagcagacccaaggccccagggagaccccttccaagcaaagcactcctccggaaggtggaagcggggccgtggctcatctgcggagccagggctgcctgtcgcggacgttgctcacggtggttctttttcgtgaaagggaacgtacaaagcttaacagttttcccttccaagcagagactcagagaaagggaaagagtgagagagagcaaaggaggggggcagctgccccacagagaaatgaaatgaacacaacttcctgatgctggccagtaaaacaaaaaattaaaaataaaaataaaaagattaagcagacctgcctaaggtgggtatctgactccattccaaagtcctgcatccctagtttgcccgaactcccaaagactgacaggcccctcggcgctgagctgacagagttccttttgtatgccagtccgccatgacctcctgagcgtccggccctgctctctgcagagacccagtccagaatacagtgagaagtggacaggccaggaagctcagatacacccattgaaactaacacatacacccgcatgccaaaaccaatccaggcaacacctcaggttccatcttaacgtgtccacaggaaacaccaccacacccaaacctcatctaacattgtccgtctttaattcgtgctcagagccagtctggggatgcctctttggaagcagtgtggtctagtttcaaggacactgggagtcagggaacctgggttctagtcccagtttcagcattcacttgctgcgtgaccttgggcaagacacttaacctctctgtgcctcagtttcccccatctgtaaaatggggttaataatgtcgacctacctcacagggctgttgtgaggaatagctaagtgattgtaaagcactttgaacgtataattgcttattaagactacaacaataataatatcatatgcctgtttactaccagaactttaagaaattcttgttttcctttgatctcttttctgttctgtaccatacttacccattgagaaggaaaattccccccttttaaagaaatctaggcaatgcacaaagatgtcaacagaggtaaccctgcaggttgcattttcacatcttaagaatagcagatttttgcccaagatgttggtcgataagggtgtctgatcttgaattctcagctgattccaagtggtggttggagtctgtacatctgatgctgagcccaagacacccaaagtggccagtttgggttttaagatcaacattcaaagtagccatagtgcagaggtaatgcagaagaatctaaaaaaa

SEQ ID NO: 2705 - DNA, 9341 bp, Homo sapiens
  ENST00000288139
ggtcccgagccagcggcggcgcgggcggcggcggcgggcaccgggcaccgcggcgggcgggcagacgggcgggcatggggggagcgccgagcggccccggcggccgggccggcatcaccgcggcgtctctccgctagaggaggggacaagccagttctcctttgcagcaaaaaattacatgtatatattattaagataatatatacattggattttatttttttaaaaagtttattttgctccatttttgaaaaagagagagcttgggtggcgagcggttttttttttaaatcaattatccttattttctgttatttgtccccgtccctccccacccccctgctgaagcgagaataagggcagggaccgcggctcctacctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctggtgctggtggagacggagaggcgcggccaaggcggggccctctgggtgtcggcggtggggtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcactccgatggtcggtttctgactgtcacgctaagggcaactgtaaactggaataataatgcactcgcaaccaggtaaacttagatacactagtttgtttaaaattatagatttactgtacatgacttgtaatatactataatttgtatttgtaaagagatggtctatattttgtaattactgtattgtatttgaactgcagcaatatccatgggtcctaataattgtagttccccactaaaatctagaaattattagtatttttactcgggctatccagaagtagaagaaatagagccaattctcatttattcagcgaaaatcctctggggttaaaattttaagtttgaaagaacttgacactacagaaatttttctaaaatattttgagtcactataaacctatcatctttccacaagatataccagatgactatttgcagtcttttctttgggcaagagttccatgattttgatactgtacctttggatccaccatgggttgcaactgtctttggttttgtttgtttgacttgaaccaccctctggtaagtaagtaagtgaattacagagcaggtccagctggctgctctgccccttgggtatccatagttacggttttctctgtggcccacccagggtgttttttgcatcgctggtgcagaaatgcataggtggatgagatatagctgctcttgtcctctggggactggtggtgctgcttaagaaataaggggtgctggggacagaggagcaacgtggtgatctataggattggagtgtcggggtctgtacaaatcgtattgttgccttttacaaaactgctgtactgtatgttctctttgagggcttttatatgcaattgaatgagggctgaagttttcattagaatgcactcacactctgactgtacgtcctgatgaaaacccacttttggataattagaaccgtcaaggcttcattttctgtcaacagaattaggccgactgtcaggttaccttggcagggattccctgcaatcaaaaagatagatgataggtagcaattttggtccaaaatttttaatagtatacagacaacctgttaatttttttttttttttttttttttgtaaataacaaacaccactttgttatgaagaccttacaaacctcttcttaagacattcttactctgatccaggcaaaaacacttcaaggtttgtaaatgactctttcctgacataaatccttttttattaaaatgcaaaatgttcttcagaataaaactgtgtaataatttttatacttgggagtgctccttgcacagagctgtcatttgccagtgagagcctccgacagggcaggtactgtgccagggcagctctgaaattatggatattcttatcctcctggttccttcggtgccaatggtaacctaataccagccgcagggagcgccatttctcctaaagggctacaccactgtcaacattatcctggactctgtgtctctctctgttgggtcttgtggcatcacatcaggccaaaattgccagaccaggaccctaagtgtctgatagaggcgatgatcttttccaaagtcagtacttacaaactggcattcttacaggctgcaccatttcctagtatgtctgctttaagcctggttcaacctctcatcgaatattaaatttttctttgtaagaaaaa

SEQ ID NO: 2706 - DNA, 670 bp, Homo sapiens
  ENST00000636480
gttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtagggtaagtctcttttactttggggaaatgttgatttggaaa

SEQ ID NO: 2707 - DNA, 6414 bp, Homo sapiens
  ENST00000422281
atgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactggatgaatgatgctatgggatttgaattgccctgggtgtattttgtcagtctcgtcatctttgggtcatttttcgtactaaatcttgtacttggtgtattgagcggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctgtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtag

SEQ ID NO: 2708 - DNA, 6441 bp, Homo sapiens
  ENST00000636570
atgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctgtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtag

SEQ ID NO: 2709 - DNA, 5673 bp, Homo sapiens
  ENST00000640483
atgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctggtgctggtggagacggagaggcgcggccaaggcggggccctctgggtgtcggcggtggggtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaagcactatttcactgatgcatggaacacttttgatgccttaattgttgttggtagcgtcgttgatattgctataactgaagtgaataactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacagatgcttgaacggatgctttagaattttctgcctgagctacggcaccaagctggttagtcggaaggcgtttgtggctaaggccttgaaagggaaaagtctcaagtgggcttatttctactgaaacagcatttcagaagaaatgcaggaaaaagcagacccaaggccccagggagaccccttccaagcaaagcactcctccggaaggtggaagcggggccgtggctcatctgcggagccagggctgcctgtcgcggacgttgctcacggtggttctttttcgtgaaagggaacgtacaaagcttaacagttttcccttccaagcagagactcagagaaagggaaagagtgagagagagcaaaggaggggggcagctgccccacagagaaatgaaatgaacacaacttcctgatgctggccagtaaaacaaaaaattaaaaataaaaataaaaagattaagcagacctgcctaaggtgggtatctgactccattccaaagtcctgcatccctagtttgcccgaactcccaaagactgacaggcccctcggcgctgagctgacagagttccttttgtatgccagtccgccatgacctcctgagcgtccggccctgctctctgcagagacccagtccagaatacagtgagaagtggacaggccaggaagctcagatacacccattgaaactaacacatacacccgcatgccaaaaccaatccaggcaacacctcaggttccatcttaacgtgtccacaggaaacacc

SEQ ID NO: 2710 - DNA, 4349 bp, Homo sapiens
  ENST00000636627
tgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctggtgctggtggagacggagaggcgcggccaaggcggggccctctgggtgtcggcggtggggtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaagcactatttcactgatgcatggaacacttttgatgccttaattgttgttggtagcgtcgttgatattgctataactgaagtgaatccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtggtcagtgcagtctatttcctaagtagtccttggccagtgctttggttttaatgctagtgtctccagaaagtccagagagtgtttgcaaaatgctttatgtatcatttagagcattaaggccaactgataaagaaagccctttggccatttggtgtgattattttgggggtgatatgaagaacattccagacaaaggagaggcttcagtgaaaaaccaaaactcacatggctggagcagggattttctttttggtgga

SEQ ID NO: 2711 - DNA, 791 bp, Homo sapiens
  ENST00000481085
ctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatagggtcacagtggccgacttgcttaaagaggataagaagaaaaagaagttttgctgctttcggcaacgcagggctaaagatcatgctagcatgcccaccagcgagactgagtctgtgaacacagagaacgtcagcggtgaaggcgagaaccgaggctgctgtggaagtctctgtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattgg

SEQ ID NO: 2712 - DNA, 493 bp, Homo sapiens
  ENST00000464429
cagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactgggtaaatgatgcgataggatgggaatggccatgggtgtattttgttagtctgatcatccttggctcatttttcgtccttaacctggttcttggtgtccttagtgggtaagcagtcggatccgtgttgcaccttctcctgctgccacgtgtgaggcaactctgcgtgtctcctagctgctccctgacagcttctctgcatgtgtttggactctgatgtcctctcagtgtgttgcttttggattgaactgtgattctttctgcctgtatctgtctgtgagattccgtgtttccaatgcttgccaaacactgttaatttaatgaaaacgttcccccaaa

SEQ ID NO: 2713 - DNA, 5667 bp, Homo sapiens
  ENST00000481478
gccaatggcacggaatgtaggagtggctgggttggcccgaacggaggcatcaccaactttgataactttgcctttgccatgcttactgtgtttcagtgcatcaccatggagggctggacagatgtgctctactggatgaatgatgctatgggatttgaattgccctgggtgtattttgtcagtctcgtcatctttgggtcatttttcgtactaaatcttgtacttggtgtattgagcggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctggtgctggtggagacggagaggcgcggccaaggcggggccctctgggtgtcggcggtggggtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaagcactatttcactgatgcatggaacacttttgatgccttaattgttgttggtagcgtcgttgatattgctataactgaagtgaatccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagta

SEQ ID NO: 2714 - DNA, 838 bp, Homo sapiens
  ENST00000498251
ttttgtcagtctcgtcatctttgggtcatttttcgtactaaatcttgtacttggtgtattgagcgggcacagtggctcacgcctataatcccagcactttcggaggccgaggcagctggaccacccgagatcaggagtttgagaccagcctgactaaggcagtgaaaccctgtctctactaaaaatacaaaaattagccaggcatggtggcgcatgcctgtaatcccagctacttgggaggctgaggcaggagaatcacttgaaccagggaggtggagattgcagtgagccaagactgcaccattgcattccagcctgggtgacaagagcaaaactccatctcaaaaaaaaaaaaaaaaaaaaaaaaaaaaaaaaaaaaagacttttctctcattcaacactttaccagcatctactgacagaaaatggacaattgaatttcctccaatatatatacctctgatatgtctgctttgtaaaagagtagtgtaattgcttacaacattgaaaaggttgttattggggtcctggggtagccaggatatcggcatgatttgtcaccatattcagaataaaactgtactgcaatagtgagttaattccatatcttggccaacagagaatttttggccagtggctactaaggcacacggaagtccagtctaaaagggacaggggaggactctttgtagatagttcttatgattaaaaaataacttcctatgtgttgtagtgatgattaagctgacagaatgctaaagacacccttaatgattacttgtagcaaagtacttccccacatttagctggatttgtctttggtttgaagaggctaata

SEQ ID NO: 2715 - DNA, 216 bp, Homo sapiens
  ENST00000637301
gaggaagaaggaggagaggaaggcaaacgaaatagggtcacagtggccgacttgcttaaagaggataagaagaaaaagaagttttgctgctttcggcaacgcagggctaaagatcatgctagcatgcccaccagcgagactgagtctgtgaacacagagaacgtcagcggtgaaggcgagaaccgaggctgctgtggaagtctctggtgctggtgg

SEQ ID NO: 2716 - DNA, 890 bp, Homo sapiens
  ENST00000637714
ggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatgctaggttacgcagactatgtcttcactggtacttttgcatttgagatcattttaaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctg

SEQ ID NO: 2717 - DNA, 710 bp, Homo sapiens
  ENST00000636138
atacagagtaacatggttatttggtttcttgtgctcttttctcttctctttagaaaagagagcctagaaaataaaaagaacaacaaaccagaagtcaaccagatagccaacagtgacaacaaggttacaattgatgactatagagaagaggatgaagacaaggacccctatccgccttgcgatgtgccaggatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaa

SEQ ID NO: 2718 - DNA, 575 bp, Homo sapiens
  ENST00000637078
gagtaacatggttatttggtttcttgtgctcttttctcttctctttagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactact

SEQ ID NO: 2719 - DNA, 850 bp, Homo sapiens
  ENST00000636723
gttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaagaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtc

SEQ ID NO: 2720 - DNA, 1830 bp, Homo sapiens
  ENST00000638120
ctcttagtgctggctgtttgggcctgaggctgatgggagagacctggttgtgtccagcagccttggggttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacagatgcttgaacggatgctttagaattttctgcctgagctacggcaccaagctggttagtcggaaggcgtttgtggctaaggccttgaaagggaaaagtctcaagtgggcttatttctactgaaacagcatttcagaagaaatgcaggaaaaagcagacccaaggccccagggagaccccttccaagcaaagcactcctcc

SEQ ID NO: 2721 - DNA, 669 bp, Homo sapiens
  ENST00000638129
ttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatg

SEQ ID NO: 2722 - DNA, 3978 bp, Homo sapiens
  ENST00000636448
ggtcttcaccggggtgttcaccgtcgagatggttttgaaagtcatcgcatttaagcctaagcactatttcactgatgcatggaacacttttgatgccttaattgttgttggtagcgtcgttgatattgctataactgaagtgaatccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaacaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcactccgatggtcggtttctgactgtcacgctaagggcaactgtaaactggaataataatgcactcgcaaccaggtaaacttagatacactagtttgtttaaaattatagatttactgtacatgacttgtaatatactataatttgtatttgtaaagagatggtctatattttgtaattactgtattgtatttgaactgcagcaatatccatgggtcctaataattgtagttccccactaaaatctagaaattattagtatttttactcgggctatccagaagtagaagaaatagagccaattctcatttattcagcgaaaatcctctggggttaaaattttaagtttgaaagaacttgacactacagaaatttttctaaaatattttgagtcactataaacctatcatctttccacaagatataccagatgactatttgcagtcttttctttgggcaagagttccatgattttgatactgtacctttggatccaccatgggttgcaactgtctttggttttgtttgtttgacttgaaccaccctctggtaagtaagtaagtgaattacagagcaggtccagctggctgctctgccccttgggtatccatagttacggttttctctgtggcccacccagggtgttttttgcatcgctggtgcagaaatgcataggtggatgagatatagctgctcttgtcctctggggactggtggtgctgcttaagaaataagg

SEQ ID NO: 2723 - DNA, 850 bp, Homo sapiens
  ENST00000637081
ggttttgaaagtcatcgcatttaagcctaaggggtattttagtgacgcctggaacacgtttgactccctcatcgtaatcggcagcattatagacgtggccctcagcgaagcagacaaaattgtagcggcaagtatatataagcatatatacggtgaagtccttaaagcaaagcacttctaaagaatgtgtgcttgtttttggcctctccacctttggttttcactgcgctccacaggacgtgctaaggattggttgcaatcatctaaattgttccccatcccatagattgtcatctccagcctggggccatcttggtcagtcacacttggctctgtgacttgccaacatagtcttccagaatgaatgatctggctgagaaatgattgaattcagcctgcgtttgtattctttgcaaaaacgttttgggtagtcctttgcatggtcctgcctgcgcacgcaccagcctgcttcatcctactgtccccctcccatgtccccacaccccgctcagttcctggtttggcagcactcatggacttatctccatcacatttggtcctaacctcaccaggctgctaaaatgacacactgtgactgctgggctccctcttgctccgtccctctttgatgcctgtttgttccttgaatgatgaaatgacccagcaacatactgtccctaacccatggatggctgtcactgacatttgtctcttctcattatcattagtgtctgggaggcaaaacacttgtttagaagctgtatctgccttattattacttactttgaaggagcaggtaaaaagtcattagggagctcactctcagagatccaggaatggtccctgcctt

SEQ ID NO: 2724 - DNA, 1600 bp, Homo sapiens
  ENST00000636595
ggcatgggaaagggactgggcctgcctaacagaggagccctaacatcaagtgggcagtgggatgggttgtgggtggagggaggcagcctagtctaagaatggaggcagtcgaagagcccaggtggctgtagatctctgctggcaggctccttgcagattctccacgtgtgcaggtgctgtctttcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgttttaaaggtgcaggatctgttcacccagtgccaccacaccagcattctagcatccttgggccgggcacgtgatgagcctttggtgtgtttcgtgaccagcgaacttttatagcgtcgctgccgccacggctttcgagactggtctggctcaggtctggtagctgacttcaggacccaggccaggacggtgaccgaggccctgcccctgagaaggtgatgagctctggctcttggggcgcagacagagcagcatgccagccagctctgctccttagcatgaagcgagaagcaacgtgagcttttgttgctgaaggggttacccgtagctggcacagccacaggctcaaagctggggaagatggcccagaaagaaatgataaaaggaagacaaaccaacaacaacaacaaaacaaaacaaaagtcctcccacctggagggccctggcttcccacaggagaaccgatactgcacatttaaaacaactccttggttttcattcttttctttttagctgcacacctaagagcttgcatggcttacatgaaatgctttggaaaaattgtaacaatgtgcttgagcttttcctgcagcctccattcctttcacctctcagtctttcagaatattctgaagcaattctgttttagggtggtggcatggaatcagagttatctcttgccaactgtattcccctacgttgtttctttaaatacagatgcatgcttcagaa

SEQ ID NO: 2725 - DNA, 4394 bp, Homo sapiens
  ENST00000636633
cacatatgttctcataaaaaaaagccatctcagaactgcaagctgcatggcacacacaaccccagattcacccagcaggcgtttgtaagcatctgcaggtttctctagaatgtcagtctgctccctaaatctcacaagtaaaactctttagtaccttcccattgccctgaagataaagcccactcttctgcccggggctcacagcccctgcctgttgcctcctgcccttgtctccagcctggtcttttatctgtctgctcatcacacgttattttcattccctcggtatctatgctgtcaccctgctcctatgcacatggtgctccctccacccgaaacactcttcgcctttcctatcacctgatgtatctttcagttctgagtttacatgtcacttccccctagaggccttccctgacccagccccccagccttcagtagatgagcctgtctcacgcttccctgtgtgtctggaccaccccagcatcatcactggggtttgatgttgcctggctacctttgtgtctcccccaggggagatccgcgaatgtgagaccgtgcccctctggagcaccacgttcccagtgtgtaacctgctgcctggcacatggttgtgcctggcagatcttttttgaatgagtgaagtgccaggtaccatgagaaaaccctagctggtaaagatcaaacctgagttagttctaaattcacatacggattttttttgcatgacgaaatctattctctttttcctgacaacttctccacctagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaagtaattattccacgcctagctacacactggccatctggaaatagcagggcaggactccagtttgggcagttaatcatccacagaagagtctggagaatgcagcccatccccagggcctagaggggctttcagaccacaccctccccctcttacagaccctccccaggcatcagcacctcttctagggccaggccagctctttccctgagcttacccagcttcccctcactgcctgcttctgaggagctcggccacagccgctggccctgtggatgagcatcctgagtccttccggcagctgcctttgctaccctcctccttcccgggccagctctttgatctgccagctggctgtcagtcccccagcccagagagcatgcccaaccttggggccaccagccagcccagctgggtataagtcaccccaacttggagcaactggaagagcacactcgagtgacagccgacagcttgctccccagctcaggaaatcgcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcactccgatggtcggtttctgactgtcacgctaagggcaactgtaaactggaataataatgcactcgcaaccaggtaaacttagatacactagtttgtttaaaattatagatttactgtacatgacttgtaatatactataatttgtatttgtaaagagatggtctatattttgtaattactgtattgtatttgaactgcagcaatatccatgggtcctaataattgtagttccccactaaaatctagaaattattagtatttttactcgggc

SEQ ID NO: 2726 - DNA, 1526 bp, Homo sapiens
  ENST00000637589
gtacattagtgaaggatgatggttctccatgtcccccagcccatcaagcttcaggatccatgtcaatggatgccaccgtcagcacattttaaaataagggtgactctgagggctcatgatcaacatcaagtgcccagcacttaagacagcctgagccaggtggctgagtgctttacctgcttcctcccacatcatcctcacggctcctctgagaggcttatccccactttacagatgagaatacaagctcagagaggttgagccccttgcccccacatcagcatgtagatcttgcaagggtggcctggcctaaaagccagctgctctgtagcctttggaccagcaaccattcctccttccagcctctgcaagttgtggtcagtggcccccagggccccacatggccccacacacatgggacggagtactaaagtggtcacaagctttacccccaagagacacagcacactgaagatttggtagcaagcagccgtgggagagccatggggcacatttacacgtccaaagtggtttaccatgagacagccagagcctctattctgcctcatgcatcacctttaaagtcatcagcagagttctgattccccaaccatacacgttggaggttgtttctgaacaaagcaaaaataagcccagctcaactatgaggttggttggagctgtcactacagtgcagaaaatgagctgttcagaattacaaaccaagaaatggtatatggagcttattggtggagaatagggggcggggagctcatgaaaatctgaatttgcagtcacttttctaaaccttcctctccttctgagcatgtatgtcacctttctaggtctctatcttgagacatcgggatttggacggttaattgcccttgataagtttatggtagttatacatgcaaatccctatgcacaggggtgaaatgtggcccgtgaagcctctttttgttttgtaatttttattttaagtaaataaccaagacagcatttcatagtgttactaatatgctgctctattaaactcataacaaatatattattttctgcaacctagagtatcagttcatttaactgacactaattttgagccttagttgctttgcaaaaccttgctttttgctggtttgagacccctgtgttatatgctgagacctcggtgccttctgcgccggaccgcccacccgccccactctgcccctgcccctgccccagccagaagcaagtgtttaggctcttggtctaatgtgctgattcgggagagctctgtctggtctctccgtttagatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaa

SEQ ID NO: 2727 - DNA, 1749 bp, Homo sapiens
  ENST00000636629
aatctcattctgttttctaatggaactagtctaaaaaggtcccctctcattgggtatagactgaatcctgctaaagggttaaccagaacttgtcaccagcgagacgactgtgtgcagggccagcctaggctgagtgcagcctgcctgtgatggggaacaggctctgccaggcagggttctttggctggagtctcaaagcctggcgcttgtatcctgaagatgaatggcctggcccagtcccgactagagacatgcatctcttatctccactgctacagcgcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagtcccctctttcctcagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggca

SEQ ID NO: 2728 - DNA, 4212 bp, Homo sapiens
  ENST00000636999
ttgtaggcgagcctactgaagactgtcactgagacaggggcataagctcttggcctggcagatcctagcactagtaaccaggcagtgttccttggaagtgggggttttgcaaaggaggttacggggttgcaggcctcaggcatcctacctaggaccttcttgaccctctggatgcctgaccataccaacaacccttagactgccttcagtgacatcagtcagtgccctggattggcttttggggaagccttcctccccaccgctgaatcaggaaggagcaaagccaggacccaggctggccccagggcccatgtgtggtctaacctgttctgccattttcattgatctaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcactccgatggtcggtttctgactgtcacgctaagggcaactgtaaactggaataataatgcactcgcaaccaggtaaacttagatacactagtttgtttaaaattatagatttactgtacatgacttgtaatatactataatttgtatttgtaaagagatggtctatattttgtaattactgtattgtatttgaactgcagcaatatccatgggtcctaataattgtagttccccactaaaatctagaaattattagtatttttactcgggctatccagaagtagaagaaatagagccaattctcatttattcagcgaaaatcctctggggttaaaattttaagtttgaaagaacttgacactacagaaatttttctaaaatattttgagtcactataaacctatcatctttccacaagatataccagatgactatttgcagtcttttctttgggcaagagttccatgattttgatactgtacctttggatccaccatgggttgcaactgtctttggttttgtttgtttgacttgaaccaccctctggtaagtaagtaagtgaattacagagcaggtccagctggctgctctgccccttgggtatccatagttacggttttctctgtggcccacccagggtgttttttgcatcgctggtgcagaaatgcataggtggatgagatatagctgctcttgtcctctggggactggtggtgctgcttaagaaataaggggtgctggggacagaggagcaacgtggtgatctataggattggagtgtcggggtctgtacaaatcgtattgttgccttttacaaaactgctgtactgtatgttctctttgagggcttttatatgcaattgaatgagggctgaagttttcattagaatgcactcacactctgactgtacgtcctgatgaaaacccacttttggataattagaaccgtcaaggcttcattttctgtcaacagaattaggccgactgtcaggttaccttggcagggattccctgcaatcaaaaagatagatgataggtagcaattttggtccaaaatttttaatagtatacagacaacctgttaatttttttttttttttttttttttgtaaataacaaacaccactttgttatgaagaccttacaaacctcttcttaagacattcttactctgatccaggcaaaaacacttcaaggtttgtaaatgactctttcctgacataaatccttttttattaaaatgcaaaatgttcttcagaataaaactgtgtaataatttttatacttgggagtgctccttgcacagagctgtcatttgccagtgagagcctccgacagggcaggtactgtgccagggcagctctgaaattatggatattcttatcctcctggttccttcggtgccaatggtaacctaataccagccgcagggagcgccatttctcctaaagggctacaccactgtcaacattatcctggactctgtgtctctctctgttgggtcttgtggcatcacatcaggccaaaattgccagaccaggaccctaagtgtctgatagaggcgatgatcttttccaaagtcagtacttacaaactggcattcttacaggctgcaccatttcctagtatgtctgctttaagcctggttcaacctctcatcg

SEQ ID NO: 2729 - DNA, 548 bp, Homo sapiens
  ENST00000637844
agttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatgtgaggccagattttttgttttgggtggaacctcccggggaacagtgtacctctcccccaacccccgctctg

SEQ ID NO: 2730 - DNA, 2854 bp, Homo sapiens
  ENST00000636581
aatgaggggcatgtggagttttgccagggctgagaaaggaggccctgtgatccgagaaaagcagcggtcaagataggagccatagaaatgccttgtaaacgataggtgtgctctcgacagaggcccctgcaaggggtaggaggtttctgggaggaggctgctggctgtgtcttagggccccagaattcagactgatctcccgggcctggtgccctgtgaagctgggagctgtggattgtcttgttaacctctgtgtgagcctctgttggaagagctgttagcaggacaagcattttcttaaaattagaggtgtcctttgtttgtattcagtgctagagaagctgaatctttcccaacaaaaataatttgcttattacctggtcaagctgatcagtgcaggtaaagtccctccctttaaaacaggtgtaaacacaggagccccagcaagatatgtcagctgctggggacacttagggtatctggaaggtgacagtgggaagtgtcgtggggttctggcaggacttgtgttcttgcactgaagtgctgtgcgctccccacagtatgcagcgccagggcttctgactcggatcagttgccctatgggctgccttcactcctcctcctgagaacaggcgaacgtttaaaagtagtaagttctctttgggaggctgaggcgggtggatcacgaggtcaggagatcgagaccatcctggctaacacggtgaaaccctgtctctactgaaaatacaaaatagtagccgggcgtggtggcgggcgcctgtagtcccagctactcgggaggctgaggcaggagaatggcgtgaacccgggaggtggagcttgcagtgagctgagattgcgccactgcactccagcctgggcgacagagccagactccatctcaaaaaaaaaaaaaaagtagtaagtttgtactttaaaaaacatccctcactggggcttctgccttcatcctctcctactaaagtttggagacctcactacctaatctttctcttggacaaaccgcatgcttcttcctgggctcgttgctgagcatccggggccaccctgactctgaaagacggtgtcccggcagagaacttgcttcacagctgtgtgatgccctttgctttcccagcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcactccgatggtcggtttctgactgtcacgctaagggcaactgtaaactggaataataatgcactcgcaaccaggtaaacttagatacactagtttgtttaaaattatagatttactgtacatgacttgtaatatactataatttgtatttgtaaagagatggtctatattttgtaattactgtattgtatttgaactgcagcaatatccatgggtcctaataattgtagttccccactaaaatctagaaattattagtatttttactcgggctatccagaagtagaagaaatagagccaattctcatttattcagcgaaaatcctctggggttaaaatttta

SEQ ID NO: 2731 - DNA, 1987 bp, Homo sapiens
  ENST00000636833
ggggccaccctgactctgaaagacggtgtcccggcagagaacttgcttcacagctgtgtgatgccctttgctttcccagcccaccggagatcctccttcaactttgagtgcctgcgccggcagagcagccaggaagaggtcccgtcgtctcccatcttcccccatcgcacggccctgcctctgcatctaatgcagcaacaggtgagcggcccacctggccttgcccccacacctaggggcaccccacataggacccccatcaggtcactcccttctccttggccttaagcaccaggagggaaggagagaatcttcacctacagtctagttaatctttgtaacaatcctgtcaaatagctatggccatgagtcccatgctgcccaagctcacacaagtgactgctggcatttgaatccagggagccagctgccaaagctggcctcactgcccaggtgcctccctgcgatccccaccacctcttcctggcattgaatacagagcctgatgtgatctgagctcagggagtgggggccacttggctgattctgaacaagcggtgcagcccttcattttctctaagaagtggttccttcattaagtttatgggtccctccatgggcagggccctgtgggtactatgcagggttaacctcccctgcctacaaagggagcagtctggggagaacagtttgcccacgttgagggcggctgcacaggcaagagggtggggccggagcccactcactagggctttccctcaaggataacaatatggcgctttttctttctgaaaatatcacatcagagatgccattcattcgtgcacgacagggtggtgggcatggacctgtgctgtttacagacagcgttccccgtccctctctgcagagtgtgaaccccaaggtgcatctgccgtggtgggattgtaagaccggggcttgtacccagtgctttagcacatgccaaatgccggctctaggatgcattactccagagcaaagagaaccagctgttttcctataagtgctgggaagtggtagtttcccctgaatgtacttcggtatttaaacccagcatgaactgggtggtgtgttcacacccacagcttgttgggcttccctgattcttcattctgaagcaatttcatgaattagcaactgatacctccttgggaaaagccaaaggaaatgcattatggattcggggtaaaagaaagcacagtctgctagaaaacaaagtcatcaccgcccattcattcagcgtacttcagtgtgcccatgtcctttccaagtccttgcctggactgcccctggcgagcgcagcgccggtgcttggtctgtgcgcagaaggtttgaggcccggacctctgagaacctctggtctcccaacagtcccctctttcctcagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtgagtacggttcttggccgtggtgggcaggaagcaccaggagcagcagaggtgcaactgtaacagcaggaagggcagtggtgggagggcggccaggctgtgagctaggctgcctcaatcagacacttctgagcagcaggaatgtacctgaagcatgagtaaaaactggtcaccaccactggctgcagtggcttacgtctgtaatctcagcactttgggaggccgaggcgggtggatcacctgaggtcagcggctcaa

SEQ ID NO: 2732 - DNA, 1795 bp, Homo sapiens
  ENST00000524607
actccttgtctctgccctctccctcccacagagcaatgttctgtgatggtgcccgagatgcgtggactgagcccagaccgcaggctgcccgagcccgccccctgcccggctgcggggagccctgagcccaggtccgcgggccgccgccaacgccacgtcctggccctgccggaagaagaggcatggcggccccagcagtgcgctctgctcgaggccgacgcctcggacgaggtgggcatgctgccggcttccccgcgcgccgcctctggcttcgacaacttcttccaggtgcaggagggcgagggccagggctgggagggcgccatggcactggaggcgggctccagccctttcctgccggtgagccccgaggtcatgaagcggcggcgcgggggcctcatcgagcagcgcgacatcatcaaggcccacgaggcgcacaagatgcagagcaccccgcaggcccggcgcaaggaatgggagatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgg

SEQ ID NO: 2733 - DNA, 2142 bp, Homo sapiens
  ENST00000533229
ggtgcctgcctctctccctgaactaggtggtgcgtctgccagaagaggagctatgtttgaagagcagcctactccacccctctcctctctggtccctgaacaccaccacacactggcattttgaaaaaaatattttcctccagaaactgggcacccccaagccctaccacccgctttttttttcttttttcttttttttttttttccttcttgaggaatggagcttcgcagaggttgcatttagattcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccgggtgagccagatgtttctctcttcttaactcatttgctgactgctaactgtaaactaatgcctcctgactcatggcagattcattcatttaaccttcatttagaagacacttacctagcagttcctctgtgccaaatgctttctagatgctgggaatgcagtagtgaaccatcattctaataatcttgattattctcaggaattaaaaagtcttgatgtcaggcacaacactgaacacagtatgtagtgagagttcatttattcatccatgctttcattcagtaactcagcagtcagagacctatgtcaaacacggtgctggttgttagggaaataaaattgaactagacacaggctgtgcctcaaaagtttcttactctgtagtgttttggggatcaagtctcatatttgtggcttgaattagtttatacaaatctgcaactatttggggtccaataccatggtaagcatcgccaggagcacacaaagtataaggtgtggttcctctccttaggaaacatgttttgccaagaagatgatacacatgaaacagagaataggagttcttttactgacttatacaaggtataatcatttgttttggggaaaggacaaatctatgtaatctgaagtcatcagggatagtttcatcaa

SEQ ID NO: 2734 - DNA, 9724 bp, Homo sapiens
  ENST00000367570
gctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaa

SEQ ID NO: 2735 - DNA, 16171 bp, Homo sapiens
  ENST00000621791
gctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgagagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaactcatcatcttgtttggtgttctgctgcctctgaacaaaagtgaatgccagccttcccttgctgggtgtcagagtctgcctcccttgaaaagaggcccctgtagaccccaacacctattcttttctctggttaattacagcagcatctgagaaattccatgcaaaagaagactacaaccagtgtttcagatataccacaagatcaaatttgggcactggtggtccacctcagaagactcttgagtcatatattcagtttctcttgctaatatatgactcgtcttcaccatctcctcaaaacaagagcaaagccaagatagaggaaggtaaaaggaggaggaaaggaaaccaaggcagggagatgttctaagtaggtttgcatttagttacccctcatttcacttaaggctccagacagactccaggtagggaatgcatgctgtctctttctctgtgtctgtctccccatctcctagaggacagagtgccagcgacctctggacaggggcagggctccagccaaggtgcccctgagccagggtcaacatagaatttcctgccccgtgaagggctggcaccagctagcatccccttggctccacatgagtcatgaacacaattgtcagtgggggtctctgctgctcttctggctgaagaatctgtttttcttctgggcttcacttgtagttcctattcaatgtctccatagggcactgagatcaccaagaacattacccagaagctgaagtccaaatgttctagattttgacctctcttgactctggggccacaaagagaaggccccataatccacctctcagccagtatctcccttctttgcacagattcctcccaaccccatagagcctatgtggtgagcatgagggtcgtcttccctctgttctcccatcccagcctctgttttgctgcatgttagcgctgatccagctcctgagatggttaattccacccaatccaagcttatttgcttgcctgactgactccaccactctctcagctatgggggaatattgcattctaatgaaatagggtttggaactcacctggtgctcctcgcaagacaactgacacaaggtgtagggtgtgggggtggacaaaatgcccacctactggataaaagctcactgcaggaaaatgaggtctcctggcataatgcaacaaaaatctcatataattttgatttttaaaaagttgttctcaatttttcattacatcctacttctcagccctctggatgtttcatttttttggacaaagtgtttctttagtggttggggccagggacaggttgagggatatttctcggctcatttataagatataaatattatgaggttgtatgtaaagaaagggcaaacgtacagcagaaggggagcaaatagctacctttcaaggattttgagatttgaaggttaaggaatttttactgctatttttgttcatcagtttcatgtctgttatgttttgagatcctcagaggcctagggttagcgtataccaagaatcctggtgagaggcgttgccatgccttggggtgaattcttccccactagctctctcacccagcctacaagtccttctctcatagatcccagagcaatgggcaccgtccaggaggtacaggagaggactttatgatgcaggaaagaaggaagaagtgggtcccttgcaagtggccagacagggaatgatggtttgactccagaaatcaggaatcaggttcaggtttggataacttctctttaaaatatctccacattgagactcttattttaacaaaatccaaacaaaattaactcagggcttgtgacctaacctttgtaagaaggtgatcaaagagatcctacattaataagcactgcctgtagcaccagctttgtctttttgtcttttgttgtttctttcctgaaccaccctgtacatcatagccaggtctaccccaaatagagcagcagctgatggcttctctgctgtctgtggagggagggctcggctgcagacctatggtgttttgtcagctgttaggtgctacagcccacccagtcagagtacatagacatagcgctttaagggacaaaggacaaacagaactatctttgctttccggaggccatctttttctttccttgaatcctttctgctttaaacttctgaggtttatgcatcccagagaggtcacaccaagccaaagagaaaaaattcatagattgtcccagcctacccaaagggcctgaaaagcctctctaaacaaaactcaagatagctgagaagtatgaatggggttcacagcaaagtccaattgatggcttttgaggctgggacacccccaaactgcccttctgtttttgtagttttgctttcttccacccaccctctctccgcatgctgtaagttaggggagttagtatcttgaacttctaaatgcaaaaggagattttataataagccatgctacctgtaaatacattattgaggtttgcatttttatttttggaggtatgaaagagttgagtagaccaagtcaaaagaggtgtggggatttatgtttatttttatttgtttggggttgtttggttggtggctgggtttcttgtaacagacctattctggaatagcaaagaaggataccttggtgatctgcaatgtttctgaatctgtttctctttaggaagtgattgccatcaaatttagtgatatgatatttgagtcaaaaatctgaggttatagtaccagctgtcttttctctctggtctcctttttgtcgtctttctctttctgtctaaattggcctctgtcttttcctaaggacttaaaatataacccaaattaatgaagaactgccccaaaacttcagtgaaagccaaggaggtacagaattttttcaggacatctttaaccaatacaaaatttatgtcttaagaagataatttttacaatagtgtagtaatctgataaatgaaaactattggaagtcaatagttttttatattccagctttctgtattcaaacttgtgccttcagcaagcatctcttcactttctttcccttgtcaattgaaacatgaatgtttggctaactcatgatgtaaagtgtctgttaagttaataatacataatttaaagcacttagtctccacaaagcaatttagaaaaatcttcacttgttagatcccatgaagtacctatgaaattctcagcattgctataagcatttgattttttttaaggaaacttcctgtttaatggaatctgaatccaagatttgctttaatttcactctattcttcccattttcccttattcttcttgttgtctctctaattaaaaaaaaaaaaaacctaggcttttttttttctatccagaaagttgggttttcatgatctgagcttccttatgtctccttctctttgtgcaaacttaaaccagtcatagattgtcacccagacatattctccaacccagcattggaaatctgaacgaatcttttctctttttgtcctacaagtttgtcagagatgagaatggattgctgtctacattctacaaccagaccctagactttataccaggctgtgccacttcctcttcacttcactcagaggatggccccaaaactgaaaaggaaatgaaataatcaaatataccaaatccgaatttgactttatttgatgactcaatattttccttccagtactctaatttttttttatggcaatggcctatatggcacaagaaccaccacttaaagcaaatctgttgaacatttttataagggatgagcaagaaaaacacactccaaaattttaaagtgccattaatcaatttttaagaataaaggtaatatgaaatgagggctaaacaatgtaatataactgccagttaaggtagacagtagttgtggtcttagttacatttgatatggagttgtgtaatattaagcagatcccagtggagttagtaaaaacataggtattgagttttaatggctaccaattgggatatatacttagcctgcaggctgaactttagtcagtgtttttctatcatgttgttttgtgaacaagtcaaaatttatacaaagctaccctaagtgctgcaattgcagaggaacttgcctcttcgtgatattagagggcagtccaactccgctcaaactgagtccaagatttgaattcatccagaaaaacaaatggaggagaaaagcctaatgcaccacatgtgtttggcatttcatggctgggacaatggagtagagggtaggaagacaagctgtagaacaaaagcaaagtgaggtagaaagtaacaggtcccagacgaggacagacttagagatgtgtaaccttggatcctctttttcacttagaatatgggtaaacttcttagcacaagactggattaagagaagttctttctgttaaactcacctagggtagtggctttgaaggcctcagaggattaatagattcccaaaattttcttccagacctgggagatggagagaaagaggttcttgctttaaagcggctcgaagacaatctttatgacttcagcaactcttcaacatagtagcaccaataaaggagagattatgttaacttcctagtggtgagaataccatgggatgggagaagggccagtgagtgggatgggaatgagcttcatcaggaacagatttcagactctgcagggtgcaccggttctagcctcaaataacaacattgcaaggaggtggactacagggtccacaccctctgtccttcggggcccatggtcaggccattccctctttgttttgctcctagaggatgagcatgtaagatgagatcaggagggaaattgggtgctctgcctcaggctgttaaaatgctgctacctgcattctaaaacgtgcaagtcatgccccacaagacacctccttagggcagcatccactgtggtgtgccagcctgacacccctgcagtcacggtgtttgaatggcagctgatgctggcccacccagagtatcggtgcatctctcctaaagccacagttcagcactgcatgttgaccaggcggatatcctataatatagatgctcgtttggatccaaaaggaaaaccattaaaaataaaagaaagatgaaaaactttaatgttttgggggggataaaagaaaagaataaataaaaccttgttgtaaagaatgcatcggcctgatttccctcacttgatgtgtttctttgctgctaccagaaagggaaatcatgggagtgaagcctgccaggaccctcagggtaagctggcagcaggctctgcagctgcacttagttggggtctgctcagaccagtcaggaggaattcaggaggctttcaaagtcccaaggacatcctggctctgaaaggttttcttttgttaaaaaatgcactttgtgctgtgtgtggtagctcgtatgtgttaccccagctattcaggaagctagggcagaaggattgcttgaggctaggaattcaagactggcctggatgacagagtgaaaccctcatctcttaaaaaaaaaaaaaaggaataaaaatgttctctgccttggataacatttttttttaaagattccatacaaactcattccctgaaagagaaaaacagattttctaatcaggacattgtcctgatctgcaagcgaggagtttaacaaggtaggcagagaacttccttatggaacaacagggctctgtgaccagaaaaactatgaccagcctcctctgaaaaaaggtggggggattatagggcaccagctcagccgccaagttcaggaagcagctgattcccaagactcttaggagatactgtccattcttcctcctgtccacatcactccccatttaactgcaattgctcccttgccacagggaaagcagcaagccccaggcccaggcctccatttgatttgccactccgagaactgtctgcttcattctgcttgaggagatatcttcacctaatcctagtgttaattattttaatctgagcaacgcttttatcaattagatagaaaccagcattccaaaataagtcccctaagtttgtagtttgagccaagatattttcttgagccctaagatatatgactttattagctaggatttttcttatgattaaaaacatccaaaaatgtgatatgtggtcatctctcagggaggtctaggtccttgcaggctggattttagaaatttctaagattctctacaacttttaaattttatgttatttttcaatcataatttctttcctgtggcttctatcaccattggagttagaatctgacaacctttaacttcacacttttatgagataataagttggtttcttgggcaaaggttggtttgtaagccatttacatggattgatgatttctgttcttgttttcttctaacctagaactcaggtccacagttttccacaggctaatggcactatgaaacagatataaagaaaaatagacactg

SEQ ID NO: 2736 - DNA, 6970 bp, Homo sapiens
  ENST00000360108
cctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgagagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggagccagaggttagtgaattaaaaagcgtgcagccctctaaccatggcatctaccttccttcggacacccaggagcatgcgggatctgggagggcatcttctatgccacgtctgactgtggatccccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggccc

SEQ ID NO: 2737 - DNA, 7067 bp, Homo sapiens
  ENST00000367573
atggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggagccagaggttagtgaattaaaaagcgtgcagccctctaaccatggcatctaccttccttcggacacccaggagcatgcgggatctgggagggcatcttctatgccacgtctgactgtggatccccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcatta

SEQ ID NO: 2738 - DNA, 7064 bp, Homo sapiens
  ENST00000357570
atggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggctggcccggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcggactcttttcgaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggagccagaggttagtgaattaaaaagcgtgcagccctctaaccatggcatctaccttccttcggacacccaggagcatgcgggatctgggagggcatcttctatgccacgtctgactgtggatccccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcatta

SEQ ID NO: 2739 - DNA, 14757 bp, Homo sapiens
  ENST00000367567
atggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccaccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaactcatcatcttgtttggtgttctgctgcctctgaacaaaagtgaatgccagccttcccttgctgggtgtcagagtctgcctcccttgaaaagaggcccctgtagaccccaacacctattcttttctctggttaattacagcagcatctgagaaattccatgcaaaagaagactacaaccagtgtttcagatataccacaagatcaaatttgggcactggtggtccacctcagaagactcttgagtcatatattcagtttctcttgctaatatatgactcgtcttcaccatctcctcaaaacaagagcaaagccaagatagaggaaggtaaaaggaggaggaaaggaaaccaaggcagggagatgttctaagtaggtttgcatttagttacccctcatttcacttaaggctccagacagactccaggtagggaatgcatgctgtctctttctctgtgtctgtctccccatctcctagaggacagagtgccagcgacctctggacaggggcagggctccagccaaggtgcccctgagccagggtcaacatagaatttcctgccccgtgaagggctggcaccagctagcatccccttggctccacatgagtcatgaacacaattgtcagtgggggtctctgctgctcttctggctgaagaatctgtttttcttctgggcttcacttgtagttcctattcaatgtctccatagggcactgagatcaccaagaacattacccagaagctgaagtccaaatgttctagattttgacctctcttgactctggggccacaaagagaaggccccataatccacctctcagccagtatctcccttctttgcacagattcctcccaaccccatagagcctatgtggtgagcatgagggtcgtcttccctctgttctcccatcccagcctctgttttgctgcatgttagcgctgatccagctcctgagatggttaattccacccaatccaagcttatttgcttgcctgactgactccaccactctctcagctatgggggaatattgcattctaatgaaatagggtttggaactcacctggtgctcctcgcaagacaactgacacaaggtgtagggtgtgggggtggacaaaatgcccacctactggataaaagctcactgcaggaaaatgaggtctcctggcataatgcaacaaaaatctcatataattttgatttttaaaaagttgttctcaatttttcattacatcctacttctcagccctctggatgtttcatttttttggacaaagtgtttctttagtggttggggccagggacaggttgagggatatttctcggctcatttataagatataaatattatgaggttgtatgtaaagaaagggcaaacgtacagcagaaggggagcaaatagctacctttcaaggattttgagatttgaaggttaaggaatttttactgctatttttgttcatcagtttcatgtctgttatgttttgagatcctcagaggcctagggttagcgtataccaagaatcctggtgagaggcgttgccatgccttggggtgaattcttccccactagctctctcacccagcctacaagtccttctctcatagatcccagagcaatgggcaccgtccaggaggtacaggagaggactttatgatgcaggaaagaaggaagaagtgggtcccttgcaagtggccagacagggaatgatggtttgactccagaaatcaggaatcaggttcaggtttggataacttctctttaaaatatctccacattgagactcttattttaacaaaatccaaacaaaattaactcagggcttgtgacctaacctttgtaagaaggtgatcaaagagatcctacattaataagcactgcctgtagcaccagctttgtctttttgtcttttgttgtttctttcctgaaccaccctgtacatcatagccaggtctaccccaaatagagcagcagctgatggcttctctgctgtctgtggagggagggctcggctgcagacctatggtgttttgtcagctgttaggtgctacagcccacccagtcagagtacatagacatagcgctttaagggacaaaggacaaacagaactatctttgctttccggaggccatctttttctttccttgaatcctttctgctttaaacttctgaggtttatgcatcccagagaggtcacaccaagccaaagagaaaaaattcatagattgtcccagcctacccaaagggcctgaaaagcctctctaaacaaaactcaagatagctgagaagtatgaatggggttcacagcaaagtccaattgatggcttttgaggctgggacacccccaaactgcccttctgtttttgtagttttgctttcttccacccaccctctctccgcatgctgtaagttaggggagttagtatcttgaacttctaaatgcaaaaggagattttataataagccatgctacctgtaaatacattattgaggtttgcatttttatttttggaggtatgaaagagttgagtagaccaagtcaaaagaggtgtggggatttatgtttatttttatttgtttggggttgtttggttggtggctgggtttcttgtaacagacctattctggaatagcaaagaaggataccttggtgatctgcaatgtttctgaatctgtttctctttaggaagtgattgccatcaaatttagtgatatgatatttgagtcaaaaatctgaggttatagtaccagctgtcttttctctctggtctcctttttgtcgtctttctctttctgtctaaattggcctctgtcttttcctaaggacttaaaatataacccaaattaatgaagaactgccccaaaacttcagtgaaagccaaggaggtacagaattttttcaggacatctttaaccaatacaaaatttatgtcttaagaagataatttttacaatagtgtagtaatctgataaatgaaaactattggaagtcaatagttttttatattccagctttctgtattcaaacttgtgccttcagcaagcatctcttcactttctttcccttgtcaattgaaacatgaatgtttggctaactcatgatgtaaagtgtctgttaagttaataatacataatttaaagcacttagtctccacaaagcaatttagaaaaatcttcacttgttagatcccatgaagtacctatgaaattctcagcattgctataagcatttgattttttttaaggaaacttcctgtttaatggaatctgaatccaagatttgctttaatttcactctattcttcccattttcccttattcttcttgttgtctctctaattaaaaaaaaaaaaaacctaggcttttttttttctatccagaaagttgggttttcatgatctgagcttccttatgtctccttctctttgtgcaaacttaaaccagtcatagattgtcacccagacatattctccaacccagcattggaaatctgaacgaatcttttctctttttgtcctacaagtttgtcagagatgagaatggattgctgtctacattctacaaccagaccctagactttataccaggctgtgccacttcctcttcacttcactcagaggatggccccaaaactgaaaaggaaatgaaataatcaaatataccaaatccgaatttgactttatttgatgactcaatattttccttccagtactctaatttttttttatggcaatggcctatatggcacaagaaccaccacttaaagcaaatctgttgaacatttttataagggatgagcaagaaaaacacactccaaaattttaaagtgccattaatcaatttttaagaataaaggtaatatgaaatgagggctaaacaatgtaatataactgccagttaaggtagacagtagttgtggtcttagttacatttgatatggagttgtgtaatattaagcagatcccagtggagttagtaaaaacataggtattgagttttaatggctaccaattgggatatatacttagcctgcaggctgaactttagtcagtgtttttctatcatgttgttttgtgaacaagtcaaaatttatacaaagctaccctaagtgctgcaattgcagaggaacttgcctcttcgtgatattagagggcagtccaactccgctcaaactgagtccaagatttgaattcatccagaaaaacaaatggaggagaaaagcctaatgcaccacatgtgtttggcatttcatggctgggacaatggagtagagggtaggaagacaagctgtagaacaaaagcaaagtgaggtagaaagtaacaggtcccagacgaggacagacttagagatgtgtaaccttggatcctctttttcacttagaatatgggtaaacttcttagcacaagactggattaagagaagttctttctgttaaactcacctagggtagtggctttgaaggcctcagaggattaatagattcccaaaattttcttccagacctgggagatggagagaaagaggttcttgctttaaagcggctcgaagacaatctttatgacttcagcaactcttcaacatagtagcaccaataaaggagagattatgttaacttcctagtggtgagaataccatgggatgggagaagggccagtgagtgggatgggaatgagcttcatcaggaacagatttcagactctgcagggtgcaccggttctagcctcaaataacaacattgcaaggaggtggactacagggtccacaccctctgtccttcggggcccatggtcaggccattccctctttgttttgctcctagaggatgagcatgtaagatgagatcaggagggaaattgggtgctctgcctcaggctgttaaaatgctgctacctgcattctaaaacgtgcaagtcatgccccacaagacacctccttagggcagcatccactgtggtgtgccagcctgacacccctgcagtcacggtgtttgaatggcagctgatgctggcccacccagagtatcggtgcatctctcctaaagccacagttcagcactgcatgttgaccaggcggatatcctataatatagatgctcgtttggatccaaaaggaaaaccattaaaaataaaagaaagatgaaaaactttaatgttttgggggggataaaagaaaagaataaataaaaccttgttgt

SEQ ID NO: 2740 - DNA, 14886 bp, Homo sapiens
  ENST00000621551
atggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccaccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggagccagaggttagtgaattaaaaagcgtgcagccctctaaccatggcatctaccttccttcggacacccaggagcatgcgggatctgggagggcatcttctatgccacgtctgactgtggatccccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaactcatcatcttgtttggtgttctgctgcctctgaacaaaagtgaatgccagccttcccttgctgggtgtcagagtctgcctcccttgaaaagaggcccctgtagaccccaacacctattcttttctctggttaattacagcagcatctgagaaattccatgcaaaagaagactacaaccagtgtttcagatataccacaagatcaaatttgggcactggtggtccacctcagaagactcttgagtcatatattcagtttctcttgctaatatatgactcgtcttcaccatctcctcaaaacaagagcaaagccaagatagaggaaggtaaaaggaggaggaaaggaaaccaaggcagggagatgttctaagtaggtttgcatttagttacccctcatttcacttaaggctccagacagactccaggtagggaatgcatgctgtctctttctctgtgtctgtctccccatctcctagaggacagagtgccagcgacctctggacaggggcagggctccagccaaggtgcccctgagccagggtcaacatagaatttcctgccccgtgaagggctggcaccagctagcatccccttggctccacatgagtcatgaacacaattgtcagtgggggtctctgctgctcttctggctgaagaatctgtttttcttctgggcttcacttgtagttcctattcaatgtctccatagggcactgagatcaccaagaacattacccagaagctgaagtccaaatgttctagattttgacctctcttgactctggggccacaaagagaaggccccataatccacctctcagccagtatctcccttctttgcacagattcctcccaaccccatagagcctatgtggtgagcatgagggtcgtcttccctctgttctcccatcccagcctctgttttgctgcatgttagcgctgatccagctcctgagatggttaattccacccaatccaagcttatttgcttgcctgactgactccaccactctctcagctatgggggaatattgcattctaatgaaatagggtttggaactcacctggtgctcctcgcaagacaactgacacaaggtgtagggtgtgggggtggacaaaatgcccacctactggataaaagctcactgcaggaaaatgaggtctcctggcataatgcaacaaaaatctcatataattttgatttttaaaaagttgttctcaatttttcattacatcctacttctcagccctctggatgtttcatttttttggacaaagtgtttctttagtggttggggccagggacaggttgagggatatttctcggctcatttataagatataaatattatgaggttgtatgtaaagaaagggcaaacgtacagcagaaggggagcaaatagctacctttcaaggattttgagatttgaaggttaaggaatttttactgctatttttgttcatcagtttcatgtctgttatgttttgagatcctcagaggcctagggttagcgtataccaagaatcctggtgagaggcgttgccatgccttggggtgaattcttccccactagctctctcacccagcctacaagtccttctctcatagatcccagagcaatgggcaccgtccaggaggtacaggagaggactttatgatgcaggaaagaaggaagaagtgggtcccttgcaagtggccagacagggaatgatggtttgactccagaaatcaggaatcaggttcaggtttggataacttctctttaaaatatctccacattgagactcttattttaacaaaatccaaacaaaattaactcagggcttgtgacctaacctttgtaagaaggtgatcaaagagatcctacattaataagcactgcctgtagcaccagctttgtctttttgtcttttgttgtttctttcctgaaccaccctgtacatcatagccaggtctaccccaaatagagcagcagctgatggcttctctgctgtctgtggagggagggctcggctgcagacctatggtgttttgtcagctgttaggtgctacagcccacccagtcagagtacatagacatagcgctttaagggacaaaggacaaacagaactatctttgctttccggaggccatctttttctttccttgaatcctttctgctttaaacttctgaggtttatgcatcccagagaggtcacaccaagccaaagagaaaaaattcatagattgtcccagcctacccaaagggcctgaaaagcctctctaaacaaaactcaagatagctgagaagtatgaatggggttcacagcaaagtccaattgatggcttttgaggctgggacacccccaaactgcccttctgtttttgtagttttgctttcttccacccaccctctctccgcatgctgtaagttaggggagttagtatcttgaacttctaaatgcaaaaggagattttataataagccatgctacctgtaaatacattattgaggtttgcatttttatttttggaggtatgaaagagttgagtagaccaagtcaaaagaggtgtggggatttatgtttatttttatttgtttggggttgtttggttggtggctgggtttcttgtaacagacctattctggaatagcaaagaaggataccttggtgatctgcaatgtttctgaatctgtttctctttaggaagtgattgccatcaaatttagtgatatgatatttgagtcaaaaatctgaggttatagtaccagctgtcttttctctctggtctcctttttgtcgtctttctctttctgtctaaattggcctctgtcttttcctaaggacttaaaatataacccaaattaatgaagaactgccccaaaacttcagtgaaagccaaggaggtacagaattttttcaggacatctttaaccaatacaaaatttatgtcttaagaagataatttttacaatagtgtagtaatctgataaatgaaaactattggaagtcaatagttttttatattccagctttctgtattcaaacttgtgccttcagcaagcatctcttcactttctttcccttgtcaattgaaacatgaatgtttggctaactcatgatgtaaagtgtctgttaagttaataatacataatttaaagcacttagtctccacaaagcaatttagaaaaatcttcacttgttagatcccatgaagtacctatgaaattctcagcattgctataagcatttgattttttttaaggaaacttcctgtttaatggaatctgaatccaagatttgctttaatttcactctattcttcccattttcccttattcttcttgttgtctctctaattaaaaaaaaaaaaaacctaggcttttttttttctatccagaaagttgggttttcatgatctgagcttccttatgtctccttctctttgtgcaaacttaaaccagtcatagattgtcacccagacatattctccaacccagcattggaaatctgaacgaatcttttctctttttgtcctacaagtttgtcagagatgagaatggattgctgtctacattctacaaccagaccctagactttataccaggctgtgccacttcctcttcacttcactcagaggatggccccaaaactgaaaaggaaatgaaataatcaaatataccaaatccgaatttgactttatttgatgactcaatattttccttccagtactctaatttttttttatggcaatggcctatatggcacaagaaccaccacttaaagcaaatctgttgaacatttttataagggatgagcaagaaaaacacactccaaaattttaaagtgccattaatcaatttttaagaataaaggtaatatgaaatgagggctaaacaatgtaatataactgccagttaaggtagacagtagttgtggtcttagttacatttgatatggagttgtgtaatattaagcagatcccagtggagttagtaaaaacataggtattgagttttaatggctaccaattgggatatatacttagcctgcaggctgaactttagtcagtgtttttctatcatgttgttttgtgaacaagtcaaaatttatacaaagctaccctaagtgctgcaattgcagaggaacttgcctcttcgtgatattagagggcagtccaactccgctcaaactgagtccaagatttgaattcatccagaaaaacaaatggaggagaaaagcctaatgcaccacatgtgtttggcatttcatggctgggacaatggagtagagggtaggaagacaagctgtagaacaaaagcaaagtgaggtagaaagtaacaggtcccagacgaggacagacttagagatgtgtaaccttggatcctctttttcacttagaatatgggtaaacttcttagcacaagactggattaagagaagttctttctgttaaactcacctagggtagtggctttgaaggcctcagaggattaatagattcccaaaattttcttccagacctgggagatggagagaaagaggttcttgctttaaagcggctcgaagacaatctttatgacttcagcaactcttcaacatagtagcaccaataaaggagagattatgttaacttcctagtggtgagaataccatgggatgggagaagggccagtgagtgggatgggaatgagcttcatcaggaacagatttcagactctgcagggtgcaccggttctagcctcaaataacaacattgcaaggaggtggactacagggtccacaccctctgtccttcggggcccatggtcaggccattccctctttgttttgctcctagaggatgagcatgtaagatgagatcaggagggaaattgggtgctctgcctcaggctgttaaaatgctgctacctgcattctaaaacgtgcaagtcatgccccacaagacacctccttagggcagcatccactgtggtgtgccagcctgacacccctgcagtcacggtgtttgaatggcagctgatgctggcccacccagagtatcggtgcatctctcctaaagccacagttcagcactgcatgttgaccaggcggatatcctataatatagatgctcgtttggatccaaaaggaaaaccattaaaaataaaagaaagatgaaaaactttaatgttttgggggggataaaagaaaagaataaataaaaccttgttgt

SEQ ID NO: 2741 - DNA, 14700 bp, Homo sapiens
  ENST00000358338
atggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccaccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgagagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaactcatcatcttgtttggtgttctgctgcctctgaacaaaagtgaatgccagccttcccttgctgggtgtcagagtctgcctcccttgaaaagaggcccctgtagaccccaacacctattcttttctctggttaattacagcagcatctgagaaattccatgcaaaagaagactacaaccagtgtttcagatataccacaagatcaaatttgggcactggtggtccacctcagaagactcttgagtcatatattcagtttctcttgctaatatatgactcgtcttcaccatctcctcaaaacaagagcaaagccaagatagaggaaggtaaaaggaggaggaaaggaaaccaaggcagggagatgttctaagtaggtttgcatttagttacccctcatttcacttaaggctccagacagactccaggtagggaatgcatgctgtctctttctctgtgtctgtctccccatctcctagaggacagagtgccagcgacctctggacaggggcagggctccagccaaggtgcccctgagccagggtcaacatagaatttcctgccccgtgaagggctggcaccagctagcatccccttggctccacatgagtcatgaacacaattgtcagtgggggtctctgctgctcttctggctgaagaatctgtttttcttctgggcttcacttgtagttcctattcaatgtctccatagggcactgagatcaccaagaacattacccagaagctgaagtccaaatgttctagattttgacctctcttgactctggggccacaaagagaaggccccataatccacctctcagccagtatctcccttctttgcacagattcctcccaaccccatagagcctatgtggtgagcatgagggtcgtcttccctctgttctcccatcccagcctctgttttgctgcatgttagcgctgatccagctcctgagatggttaattccacccaatccaagcttatttgcttgcctgactgactccaccactctctcagctatgggggaatattgcattctaatgaaatagggtttggaactcacctggtgctcctcgcaagacaactgacacaaggtgtagggtgtgggggtggacaaaatgcccacctactggataaaagctcactgcaggaaaatgaggtctcctggcataatgcaacaaaaatctcatataattttgatttttaaaaagttgttctcaatttttcattacatcctacttctcagccctctggatgtttcatttttttggacaaagtgtttctttagtggttggggccagggacaggttgagggatatttctcggctcatttataagatataaatattatgaggttgtatgtaaagaaagggcaaacgtacagcagaaggggagcaaatagctacctttcaaggattttgagatttgaaggttaaggaatttttactgctatttttgttcatcagtttcatgtctgttatgttttgagatcctcagaggcctagggttagcgtataccaagaatcctggtgagaggcgttgccatgccttggggtgaattcttccccactagctctctcacccagcctacaagtccttctctcatagatcccagagcaatgggcaccgtccaggaggtacaggagaggactttatgatgcaggaaagaaggaagaagtgggtcccttgcaagtggccagacagggaatgatggtttgactccagaaatcaggaatcaggttcaggtttggataacttctctttaaaatatctccacattgagactcttattttaacaaaatccaaacaaaattaactcagggcttgtgacctaacctttgtaagaaggtgatcaaagagatcctacattaataagcactgcctgtagcaccagctttgtctttttgtcttttgttgtttctttcctgaaccaccctgtacatcatagccaggtctaccccaaatagagcagcagctgatggcttctctgctgtctgtggagggagggctcggctgcagacctatggtgttttgtcagctgttaggtgctacagcccacccagtcagagtacatagacatagcgctttaagggacaaaggacaaacagaactatctttgctttccggaggccatctttttctttccttgaatcctttctgctttaaacttctgaggtttatgcatcccagagaggtcacaccaagccaaagagaaaaaattcatagattgtcccagcctacccaaagggcctgaaaagcctctctaaacaaaactcaagatagctgagaagtatgaatggggttcacagcaaagtccaattgatggcttttgaggctgggacacccccaaactgcccttctgtttttgtagttttgctttcttccacccaccctctctccgcatgctgtaagttaggggagttagtatcttgaacttctaaatgcaaaaggagattttataataagccatgctacctgtaaatacattattgaggtttgcatttttatttttggaggtatgaaagagttgagtagaccaagtcaaaagaggtgtggggatttatgtttatttttatttgtttggggttgtttggttggtggctgggtttcttgtaacagacctattctggaatagcaaagaaggataccttggtgatctgcaatgtttctgaatctgtttctctttaggaagtgattgccatcaaatttagtgatatgatatttgagtcaaaaatctgaggttatagtaccagctgtcttttctctctggtctcctttttgtcgtctttctctttctgtctaaattggcctctgtcttttcctaaggacttaaaatataacccaaattaatgaagaactgccccaaaacttcagtgaaagccaaggaggtacagaattttttcaggacatctttaaccaatacaaaatttatgtcttaagaagataatttttacaatagtgtagtaatctgataaatgaaaactattggaagtcaatagttttttatattccagctttctgtattcaaacttgtgccttcagcaagcatctcttcactttctttcccttgtcaattgaaacatgaatgtttggctaactcatgatgtaaagtgtctgttaagttaataatacataatttaaagcacttagtctccacaaagcaatttagaaaaatcttcacttgttagatcccatgaagtacctatgaaattctcagcattgctataagcatttgattttttttaaggaaacttcctgtttaatggaatctgaatccaagatttgctttaatttcactctattcttcccattttcccttattcttcttgttgtctctctaattaaaaaaaaaaaaaacctaggcttttttttttctatccagaaagttgggttttcatgatctgagcttccttatgtctccttctctttgtgcaaacttaaaccagtcatagattgtcacccagacatattctccaacccagcattggaaatctgaacgaatcttttctctttttgtcctacaagtttgtcagagatgagaatggattgctgtctacattctacaaccagaccctagactttataccaggctgtgccacttcctcttcacttcactcagaggatggccccaaaactgaaaaggaaatgaaataatcaaatataccaaatccgaatttgactttatttgatgactcaatattttccttccagtactctaatttttttttatggcaatggcctatatggcacaagaaccaccacttaaagcaaatctgttgaacatttttataagggatgagcaagaaaaacacactccaaaattttaaagtgccattaatcaatttttaagaataaaggtaatatgaaatgagggctaaacaatgtaatataactgccagttaaggtagacagtagttgtggtcttagttacatttgatatggagttgtgtaatattaagcagatcccagtggagttagtaaaaacataggtattgagttttaatggctaccaattgggatatatacttagcctgcaggctgaactttagtcagtgtttttctatcatgttgttttgtgaacaagtcaaaatttatacaaagctaccctaagtgctgcaattgcagaggaacttgcctcttcgtgatattagagggcagtccaactccgctcaaactgagtccaagatttgaattcatccagaaaaacaaatggaggagaaaagcctaatgcaccacatgtgtttggcatttcatggctgggacaatggagtagagggtaggaagacaagctgtagaacaaaagcaaagtgaggtagaaagtaacaggtcccagacgaggacagacttagagatgtgtaaccttggatcctctttttcacttagaatatgggtaaacttcttagcacaagactggattaagagaagttctttctgttaaactcacctagggtagtggctttgaaggcctcagaggattaatagattcccaaaattttcttccagacctgggagatggagagaaagaggttcttgctttaaagcggctcgaagacaatctttatgacttcagcaactcttcaacatagtagcaccaataaaggagagattatgttaacttcctagtggtgagaataccatgggatgggagaagggccagtgagtgggatgggaatgagcttcatcaggaacagatttcagactctgcagggtgcaccggttctagcctcaaataacaacattgcaaggaggtggactacagggtccacaccctctgtccttcggggcccatggtcaggccattccctctttgttttgctcctagaggatgagcatgtaagatgagatcaggagggaaattgggtgctctgcctcaggctgttaaaatgctgctacctgcattctaaaacgtgcaagtcatgccccacaagacacctccttagggcagcatccactgtggtgtgccagcctgacacccctgcagtcacggtgtttgaatggcagctgatgctggcccacccagagtatcggtgcatctctcctaaagccacagttcagcactgcatgttgaccaggcggatatcctataatatagatgctcgtttggatccaaaaggaaaaccattaaaaataaaagaaagatgaaaaactttaatgttttgggggggataaaagaaaagaataaataaaaccttgttgt

SEQ ID NO: 2742 - DNA, 7497 bp, Homo sapiens
  ENST00000360761
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 2743 - DNA, 7848 bp, Homo sapiens
  ENST00000352832
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaa

SEQ ID NO: 2744 - DNA, 7226 bp, Homo sapiens
  ENST00000442258
atgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 2745 - DNA, 4899 bp, Homo sapiens
  ENST00000416767
atcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggtgagccccaggctcagaggtggggctgtggtgaaggaggctggagggggcacagggccatgcttagtgatacctgctgactccggtggaggtgggctccacgaagagatcagcccttcacaccctctgctgtctaaccaccagcatgtcgcaaagcccagtccatcccacagtgccccaaaaagtgggcccatggggtctctagccgtccttaaagatgaagaaacagaggctcagagagggtaaggggcttgcccagggccacagagctacatggtggagcaggaagcacacgtggcagtgggggcaggcagccctggatgtgaatcctgtgcaaatcctgaccccaccattgtcagctcaatgacctggagcagctgacttaccagggcctcagtttcattaactggtgaatggagtcataatagaatctcctcggaggtcacaat

SEQ ID NO: 2746 - DNA, 6921 bp, Homo sapiens
  ENST00000502264
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctga

SEQ ID NO: 2747 - DNA, 6837 bp, Homo sapiens
  ENST00000512389
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2748 - DNA, 6735 bp, Homo sapiens
  ENST00000513964
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2749 - DNA, 6699 bp, Homo sapiens
  ENST00000514717
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2750 - DNA, 6714 bp, Homo sapiens
  ENST00000510366
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2751 - DNA, 6768 bp, Homo sapiens
  ENST00000503485
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2752 - DNA, 7014 bp, Homo sapiens
  ENST00000507510
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2753 - DNA, 6767 bp, Homo sapiens
  ENST00000511765
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2754 - DNA, 7116 bp, Homo sapiens
  ENST00000507336
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2755 - DNA, 6821 bp, Homo sapiens
  ENST00000506406
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2756 - DNA, 6788 bp, Homo sapiens
  ENST00000504076
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2757 - DNA, 6879 bp, Homo sapiens
  ENST00000513689
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2758 - DNA, 6849 bp, Homo sapiens
  ENST00000507609
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2759 - DNA, 6752 bp, Homo sapiens
  ENST00000503436
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2760 - DNA, 6912 bp, Homo sapiens
  ENST00000510115
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2761 - DNA, 6870 bp, Homo sapiens
  ENST00000515165
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2762 - DNA, 6795 bp, Homo sapiens
  ENST00000514181
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2763 - DNA, 6981 bp, Homo sapiens
  ENST00000515765
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2764 - DNA, 6891 bp, Homo sapiens
  ENST00000514079
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2765 - DNA, 6600 bp, Homo sapiens
  ENST00000507896
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2766 - DNA, 6731 bp, Homo sapiens
  ENST00000511768
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacgctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2767 - DNA, 6633 bp, Homo sapiens
  ENST00000505165
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2768 - DNA, 6698 bp, Homo sapiens
  ENST00000503607
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2769 - DNA, 6960 bp, Homo sapiens
  ENST00000515411
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 2770 - DNA, 7120 bp, Homo sapiens
  ENST00000429973
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 2771 - DNA, 7648 bp, Homo sapiens
  ENST00000359106
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggccca

SEQ ID NO: 2772 - DNA, 7030 bp, Homo sapiens
  ENST00000358244
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggccca

SEQ ID NO: 2773 - DNA, 1255 bp, Homo sapiens
  ENST00000570567
gcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatctttttagctctcaggacaagtcctgtagagagggcatccatcatatagtaggagggacaccagatgcagagtcaggaggaaatccaaggtcaaggcgggacttaactgctattgggaccttgggcaagtcattctccatgaggcctccagcactgctctgggcctctgtttcttcatgggtaaaatgaatggttctcaacctgagatgataccacctctcccagagggcatttggaaatgggaaagggtgattctggttttgattttttttaatagctttattgagacataactcacatatcattcaattcatccctttgaatgaatccagtggttttttaagcatgtttacagagttctgtttttttgtaaggacaaggggagtgcaattggcaatttgttactgggggaggggagagaagctaaacatcctgaaatgcttgcaaataaagaattattctacccaaaa

SEQ ID NO: 2774 - DNA, 1478 bp, Homo sapiens
  ENST00000506520
actgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcaggtagggctgaggtgggcaggatccatctgtgggctcaggtcactcagcatgggctgattccaggacagaaagagcaaggcagggtggcaaaatgccatgaaagaagcatcatattttacagcagaggctgttgctggtagcctgtgggccaaatctgggcatgttttattggtctacaacatgtttaacatgttttgaattagtgatgaatatttttaaactggtgaatttgggctgtgtgcagtggctcacacctgtaatgccagtgcattgggaggcctaggcaagaggatcacttgaggccaggagttggagaccagcctgggcatcatagcaagacccccagctctacaaaaaataaaaacaattagccgggtgtggtggtatcatctggagtcccagctgaggtgggaggatctcttgagcccaggagtttgaggctgcaataagctgtgatcgcaccactgcactccagcctaagcaatagaacaagaccctgtctctaaaaaaagaaaaaataa

SEQ ID NO: 2775 - DNA, 8138 bp, Homo sapiens
  ENST00000354983
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcct

SEQ ID NO: 2776 - DNA, 7563 bp, Homo sapiens
  ENST00000356860
agggaggaaaccgagagggagagcgagagcgcgcgagcgccggcgggctcgccgaggtctgtttccaaagtcgcccttgatggcggcggaggcaaggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaagaaccccaaatctcaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatcaaaaaagggcaaaatgaaggattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaacaaaagtggacctggtgcctatgaatcgggcattatggtaagcaaagctgtagaaatatatattcaagggaaacttcttaaacctgcagttgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacccagataccgaaaagggcctgatgtctgctttgataacaatgtcttggaggattatactgactgtggtggtgtttctggattaaatccctccctgtggtatatcattggaatccagtttctactactttggctggtatctggcagcacacaccgcctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggagtttgttgttgcattgttggtgattacatgtgaaagggttccccatacaattgttaatgaaccataagaaatgtcttgatattgacctggaattttgacttgctgcaattttactaagaaaatctctaaggggaaagaaattatttttgccttcactttttcttctgtgaaaagttaattcctgctttaagtagcaattattgaaatatatagagaaagagagaattaacattggtctaaattgttgaaatataaataatggctaattttctatgaaaaatttgccatgaataaaatgccttatgaagaacggcttctttgccaaaaataaaacacaattgatgaccaattcaattttgatggggtaatgaattgatggtttgaaaatagtaactaagaaattattaaactaaaggtgcttgagggagaaattagaatatgtgacatatttcctcataaatgtaagcaagcccttaataaatgctttgatgtaatgttccttttgttcacagtacagttatgtagtgctagccagatatttaaaaatgctctaagaaaagcttgtcaggggggagggggaaatgtttttcttgtgataaatgaactttggtttaccaagggtattttgcatgatgctgctgctattttaacttttcagttgttttttctcttactgtagagtgtagtcattgaaaagttaactgagtgatattgttatgtaagaatctgaaccttgcagtgtaaatgcacttaagtcatctttaaaatgttgttaaactactctgaatatactgtgcaatgtaaatgctgaatgattggggttagataaatggtgaaatgagaattaatgaattttatacagattcatgctttcgcctgataacctatgtacagatattttaagtacataaatcagatttgacacatttattttttgaaaagtacatatatgttctcaatgaagattcatcctaggtttcctctttgttcgtttcaatagtagcacatacaatccaaaagttcctgctactgctgcttttgcccttccattttaaatggtatgatcgtttggccaaaatttccatgcaagttgataagggttttacaataatctgaacaaataggaaaccttgaatctctatgtatgcacatgaatacttgattgtgaataataaaagttgttttttatacagcctcattggtgaaaatggttagtgtagtaaatcagatatttcattatagactaatatggtagcagattatttatgcttttaaaaattattttctggagcaaacagtatttgaagaaaaggtaaaaactatgaatgtgtaattctaagaatagttaataattttactgaaggctgaacgtatgtagatattttttatgataaaatgcagtttttctttttttggaacatgccaattactggtatgtgtatatgctggaaattttcttacatatcctttttaagtcaaagttattaacattatccagcatgctttaatatgctccacatatcaaagatataaccaataatttaacgtagcttaaaagataacatttgttttgtttttagctttgcatacatttgtaattccctcccaccaccaatataccttaggtaccatttgtgtacatttcaagattttttttttcaataaaaaggtggggggaaatggaatcactttgccaactattgttctaagagttgacatcagttaccatttctaatgcattgttgtgattttgtagtgtcattcataactggtattgacattttagaaaacaccaaagtgatttaaaatatatgtggggaaaaaaacttctcactctagtaacaatgttttaatcatgttgtttgttaaatatttaaaagttattgttcaatttttgctagactatcttaaatcatgatagtgttgggaagggggtatcaaaatataaaattgttagtttgtgtatataaacaatgcacattaaaacaattgaattgcttccagcatacaacaaactaccttaaaattatgttcaaaatctattaaatatattttcatggctaatgtcgagtatatgttttcatcaattacattgttattgtattaatcgcggttaaacttggcatctcttggcaggatcctatttaatttctgttgccatcaaaatatatttatatgcatgagttttgctataaacctttattttctgctataaagttatatattatgacaaccataaatgcaattacaaattgggtaagaacaagctgaataaaagttgttcccatgactaatattagtcttcatgcttttagcatattttttaagacagtaacactcatcccatcaaattattacattacatttagtatttttctgagttacattgacaagaacttaaattatagcctgttattaatattgatttccaacgactgaacagtacaacagatcaataaaaaagtttatacactgctttaactaatttttgttatactcatgtggcttagtgtagttagtcactaaaacagagttcaagtgagcttggcaatggtgttgagtaacaagaaagaattttgcattaatgatttctttttattttcctcatttaaacaaccagcattactgccaaacaccaaccgtggtccatatttgtaacaggtttttaacatgacatagttagcaagtttgattgaagagatttttaggtcctgggcctataagattttagtatgatcttttttcatgtttctaatgcttgaggtgttactgcttaacttgggaaaaaaaaaaacaaaaaacagtgttcctgccatttgtaagttttcctataatattccttttattaactttaaaactggacttatcgggttcaaataggcagtatcccttttaagtgacctttgcaacccaagtgttacttgcttatttgatgctctcttgtattttaaatctcatttaaatctttgtctgtgaccaacaaagcttaagattttgtcttcatttaaaactctgaatctattccattgatcatgttagacgttcaaatgtttaatggtatagtctgacctagtgaaacaaaatggatgttgttactttttttaaagaatagaatgaaataactatttcacttgcccaaaattttaaatattttttcatctaaacttgtattgtttcccatagcagaatgtcaatattcacagtacatttctgtaaagagcaaaccaatataatgttttgagtgttgaaaaaaattccagatttttgaagaattagacaactcttcatctaccttatttctagttcacacagttatctcaaattccactgaaactaatgggatactgtcttgtgtagatgccagttgagtttataatgtgacctagtaaagctgtcttttttgttgtgttgtatgagtgtcggatcatgcttttaggaatacttttattaaaatggtgtgcattcatgcaaaaggccaactggcttttgtgaacaatagatcttttctcccctttattttgttctcttgacacttttgtgaaaattacctagcctgataaaaacattttgtaaaaatttgtataatactgttataaaatatttataatcccagaaaatgttgtgttaaatcttgtgcaaaaacagtatattcagaataaaagtttatcatttaaagtca

SEQ ID NO: 2777 - DNA, 413 bp, Homo sapiens
  ENST00000469297
atcttatgattatcagtcagtatgtgagcccggtgctgcaccaaaacaaggagcaggacatcgctcagcatatgtggtcagtaatatccacggtctaatcaattctcaaggggtactcaagtgtcctcagtatcaagtagactactgaaatgaccttattattttattttatagccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccag

SEQ ID NO: 2778 - DNA, 526 bp, Homo sapiens
  ENST00000486539
tccttttgtcttacgttttttttctataccaaacaccagccatctctggtagctttcccttatgtatacattcctctctacaagtgataccttcctgctttctgtgtcattgctgtcaattcatactccatgttcaaaatgcacctcagtcattatttcctatgagatgtcttccttaaacatccttcaagtacaaatttaatagatatttaaattattaaaacatagttgtgtatctattgatatatttcctttacttcctaaacttacttctctttgtatcaccaacacctaactttgttttttagaatatgttcaatagaacatttccttgttttgtcttctgtttcagcaagggagtgaaagcacgatttgttgtgactgatggtgggattaccagagtttatcccaaagattgttggaattaaaattgatgtaaattcctggatagagaatttcaccaaaacctcaatcagagatccgtgtgctggtccagtttgtgactgcaaaagaaacagtgacgtaa

SEQ ID NO: 2779 - DNA, 840 bp, Homo sapiens
  ENST00000443883
ttaaaagactgacaccacgttttacactgtgccccaatgggtattactttgcaatcgatcctaatggttatgttttattacatccaaatcttcagccaaagcctattggtgtaggtataccaacaattaatttaagaaaaaggagacccaatatccaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaaca

SEQ ID NO: 2780 - DNA, 418 bp, Homo sapiens
  ENST00000466806
ataaacaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaaggtcagtatataatttgtttacagtgattagtgttttgtagaattaatgattaatgttcttaataggattgttgttttaaaatttaccgtata

SEQ ID NO: 2781 - DNA, 582 bp, Homo sapiens
  ENST00000464354
ggtgaagggggtgggcctgaactgatccaggaaccagttcttagaatatatttttataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgtttta

SEQ ID NO: 2782 - DNA, 419 bp, Homo sapiens
  ENST00000475237
tataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaaggttaaaagttaattgat

SEQ ID NO: 2783 - DNA, 594 bp, Homo sapiens
  ENST00000492734
tttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggtaagaggttgagctattcagtcaaagactgtcataacaaaagcacacagatgatttctacttctttctagatgatgtctctgttttccttttcattaaaccctccccaaa

SEQ ID NO: 2784 - DNA, 1429 bp, Homo sapiens
  ENST00000423588
gcggcggaggcaaggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcagatagtaaagagatttctccttctcccgaagagattttcaatgcagagtaattaaactattgtgtctctctggaggggaggatgagtgtgggccatcagaagcccctgtataagatcagggacttcctcatcttgggactcctggctggaaacccatctcactacctatgcaggtgacccctggctgtcctcctgtcatcctgtgggaattgaggtttgggcagcttgtgcaaacaaagatgttactctgctcctctgttgctatgagtaataaactctttgtctctgactca

SEQ ID NO: 2785 - DNA, 467 bp, Homo sapiens
  ENST00000461275
cgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatatgcggttcaaggagccaatatatgttggtttatatcaagtaaagagcaacgcgatggaatgatcctgccaacacgttatccctgcatggacagtgttagtaagctcacatctggtttgactcattcttcacaggcaaccctgtctcttagatggactggtagaattgcataggaat

SEQ ID NO: 2786 - DNA, 532 bp, Homo sapiens
  ENST00000484706
atttgaaatgctatagtcctagctaagaagctgtatcacagcaaatagaaagaatagagtggctagggagactcgtgagtttggtattagaatgctagtttgatatagttatcattggaaaattatgcactataaatttgaggctatgaccaaattatgcatttatatatgtgtgtatatgtgatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggct

SEQ ID NO: 2787 - DNA, 3858 bp, Homo sapiens
  ENST00000356253
cggcggaggcaaggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaagcctattggtgtaggtataccaacaattaatttaagaaaaaggagacccaatatccagaaccccaaatctcaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaacaaaagtggacctggtgcctatgaatcgggcattatggtaagcaaagctgtagaaatatatattcaagggaaacttcttaaacctgcagttgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacccagataccgaaaagggcctgatgtctgctttgataacaatgtcttggaggattatactgactgtggtggtgtttctggattaaatccctccctgtggtatatcattggaatccagtttctactactttggctggtatctggcagcacacaccgcctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggagtttgttgttgcattgttggt

SEQ ID NO: 2788 - DNA, 5329 bp, Homo sapiens
  ENST00000423994
atggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagttgccaatcagcaaactgaaggattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagcagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttcaaa

SEQ ID NO: 2789 - DNA, 5304 bp, Homo sapiens
  ENST00000429770
gaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagcagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttc

SEQ ID NO: 2790 - DNA, 5476 bp, Homo sapiens
  ENST00000266039
gcgcagcccgcagaggcgctgcggcccgtgcagccccggaggcccctcgcggagaaggcggcggcggaggagaggccgagttaccgcccgccgcccgcgcccccccaaccccgccgccgccgccgccgccgccactgccccccctccccgcggcgccgcatcttgaatggaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttc

SEQ ID NO: 2791 - DNA, 5272 bp, Homo sapiens
  ENST00000360963
gcgaagcgagtggctgcagagggctgcatcctgccgtccccagccccccacaaccgtacagccgtgcccaggtttccgcttagggaaccaggaggtccaggccctttctgccagcagccgggcgtgcaagcccccgacagagagaaatcttaaagatagctagagccacgggggctgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttc

SEQ ID NO: 2792 - DNA, 2526 bp, Homo sapiens
  ENST00000483620
gaaggtgctccctggccgggagggctcagaagagaagtagggcatggcatcgtcctctgctgaccacctgcactcggctccccgtgcgctgcaggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgtatcctgcccccgccctccccgccgcccgctccccctctgccccgcgcgccccctccgtgccgccgccgccgtccgcctccttgactccccacccatgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttc

SEQ ID NO: 2793 - DNA, 5206 bp, Homo sapiens
  ENST00000424201
atggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgt

SEQ ID NO: 2794 - DNA, 3453 bp, Homo sapiens
  ENST00000479441
atggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagttgccaatcagcaaactgaaggattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctga

SEQ ID NO: 2795 - DNA, 1030 bp, Homo sapiens
  ENST00000487413
agagcgcttggagccagcgctgcagggagatagcagcgcgcagcccgcagaggcgctgcggcccgtgcagccccggaggcccctcgcggagaaggcggcggcggaggagaggccgagttaccgcccgccgcccgcgcccccccaaccccgccgccgccgccgccgccgccactgccccccctccccgcggcgccgcatcttgaatggaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagcagctcctgacattcccaactgggaagctctcagagatgggccattctccaagccccaaatgggctcagccctggccgaaggagggacaaggaagaatcagtccccaacatgacctcaagaaaatctggtgcagagtggccacctctgtaaatcagctgatgcctgcaccactgtaaccacagctgttgacaggctgcagggcagaagctaagcaggaagaggcccagagcagagggcaagtgagcacggcagtaagaagttgaaaaccattaattgtccgtccagaggaggcggatgcccacaacattctgggcaaaggagatggtgtgtgcaaaagcacggaggtgtgagaatatagcatagtagacattcatcattcctttctcatgcactggagtgtctgtgcagccagg

SEQ ID NO: 2796 - DNA, 3675 bp, Homo sapiens
  ENST00000474759
cggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataa

SEQ ID NO: 2797 - DNA, 3557 bp, Homo sapiens
  ENST00000490478
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataa

SEQ ID NO: 2798 - DNA, 3477 bp, Homo sapiens
  ENST00000471363
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataa

SEQ ID NO: 2799 - DNA, 1972 bp, Homo sapiens
  ENST00000477024
gttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtatt

SEQ ID NO: 2800 - DNA, 559 bp, Homo sapiens
  ENST00000492460
cccctatatttatctttaacctcaagtgaatgttgctgcctttgtagttcatgagcaatgtatactcttgaattccagctctgtgaaatcggtagaaaatgagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttt

SEQ ID NO: 2801 - DNA, 1826 bp, Homo sapiens
  ENST00000468658
tatttaagcatctgtaggaacatgctgacagcctacttcaagtcctcctctcctttcagttttcaggaaactgtgtactgcctgacttcagtgtgggtccacctctggcatctttatagtagcagaacttattcgaaaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagt

SEQ ID NO: 2802 - DNA, 495 bp, Homo sapiens
  ENST00000478466
cacactcctgaaaaggggattgcacagaggcacaaagacctctggtgtttccagtccgggtagactggctgtcaccactggggcactggtgggtacctgtgagctgatgagtgggaccaaacggctctggccaccttggaccccattcctcccaggctttgtctctccctgagccctgcgcttgagaacattaaaagccatgccttggacccccttgttctgagtcctgccatgggccgtgaggacagccggccactcttcctggtgagcagattgtcactcggctccagctgcacgtccagctcttccgctgttttgctcacggtaaatgcgtcactggagaagggaaggtggatttttgcagttccacgtgcctggcacaaggatatcatttgaaatacaaagagtatgagaaagacgttgccatagaagaaattgatggcctccaactggtaaagaagctggcaaagaacatggaagagatgtttcacaaga

SEQ ID NO: 2803 - DNA, 760 bp, Homo sapiens
  ENST00000478261
catagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtccactcactaccacggaaaccagtaaggggtatcagtggtaaggaaacctgggggagaaatattagagaaggaaaattacatcctttccactgttggagagagagagtagttaagagagttgtcattgccaaattttgacctctgaaatgcagagtagaaaaaagcaatccttggaaacatgccttaactacagtcaacataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactga

SEQ ID NO: 2804 - DNA, 740 bp, Homo sapiens
  ENST00000471865
attcttctcttcagccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtatatccttttgtgtgcaggtccactcactaccacggaaaccagtaaggggtatcagtggtaaggaaacctgggggagaaatattagagaaggaaaattacatcctttccactgttggagagagagagtagttaagagagttgtcattgccaaattttgacctctgaaatgcagagtagaaaaaagcaatccttggaaacatgccttaactacagtcaacataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaagg

SEQ ID NO: 2805 - DNA, 3661 bp, Homo sapiens
  ENST00000415676
cacccgctcctttttctgctccccaagtgagccgcgcgctcgcccaccgcccgctccgcgcagctccccgcggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtg

SEQ ID NO: 2806 - DNA, 3296 bp, Homo sapiens
  ENST00000620722
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgtt

SEQ ID NO: 2807 - DNA, 3671 bp, Homo sapiens
  ENST00000288197
cggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatc

SEQ ID NO: 2808 - DNA, 477 bp, Homo sapiens
  ENST00000547693
aaataacataacttctttcctctgaatggtcgaagctgagcaacttggagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagaggtgatcgacccccctacttccagaagcctctaacttcattttcttgctcttgctccagatcctaatgcttctgacttgaatcctcagtctaattccccaagctaatcagctcttctccttaacacacacctgtccacccctcatatctaagatctcatccccagggtctccatccttctga

SEQ ID NO: 2809 - DNA, 754 bp, Homo sapiens
  ENST00000550391
agaaaggggcgggaggggtactgacccgaggagcggtcccgcgactctgtactccctgctgcccagtcccggccaggacgctgcccggcttagctggggcgcccctcgagaccaggatggagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgg

SEQ ID NO: 2810 - DNA, 1814 bp, Homo sapiens
  ENST00000540990
actgacccgaggagcggtcccgcgactctgtactccctgctgcccagtcccggccaggacgctgcccggcttagctggggcgcccctcgagaccaggatggagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctca

SEQ ID NO: 2811 - DNA, 929 bp, Homo sapiens
  ENST00000549226
gtactccctgctgcccagtcccggccaggacgctgcccggcttagctggggcgcccctcgagaccaggatggagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctaggtagcctccccccaacccacccattttgggtaggtgggtagctaagacacagggaaagaggggatcctgcccaagtgaactgtgtgggaagggtttgtggagggattggaaggggtggggagaagccagtatctcccctggggacggggataccatgcccccagggacctttcccccttcaccaactttaatcttgtatttccttttccaaaaagccaagcagaagcaaaagcaggtgagtcaaggaagggacctgggctggggggatcatggcttatggctctggggacagtgttctaggcagtcattgttggagggcagaacagagaggggagggagcccagaacctctggatctgccctgacgccaaccaggcatgagacaggcaccagggccatggtttctactgacctcatgtccattctgca

SEQ ID NO: 2812 - DNA, 4029 bp, Homo sapiens
  ENST00000548860
gtcgcttcgcctcgcccttccccttcgcggagctgagacccgctgcaccagaacccaggagaggggggagacggcagagactccgcgggcgcggggcgatcccagctgggctctctccacagggatgccgatccctctggagacacagagccgagccggggacgggtggatgggcgccttgacgcttgggcgggcgagcagagcaccagcactcttgcttttcggtcctttcccccgccgaggtcggggtcgcagccgccgccggaggatgggcggccggcgcacggagcagggccgggagggagcagaagcttccgccaagagctcaggagctggggcagccctggagctcttcctgcccttctgcccgcggcggcggaaactccagagtccctactctttctcgggaggactttagggaagaagcagagcggcaggggaagccgaggagcgagggtgcgacgtggggatggaaggacagtgggaggcacacggaaaaacagaacgaggaccttagacaggagagacggaagtggagagaggctgggctgaaaggcagggagagccagagactgacagaggcggcgagaaaggaagggagagggagggagggaggagggaggagaaagagggagggaaccaggggagagggaagggagcaggcggcggagcccggcgggcgtggggcgaggccaggcgtgcaggcgggagcagcgtgcagagcagcggccgggttttgctcccgcctcggagcccctggcccgggggagggggagaggccgctagcctggtctatgtctttttctgactccagtgcaaccttcctgctgaacgaggcccctgaaagaaggaattgaagagaaaggatgaaagagggggatacaaggaatactgcgtaactgggtgagggcacaaaagtgggcagtgtctgggaacttccaatacagaagaatccagtatatgaccaaaccccagttggtgctggactcaggagaggagacagtcccttcagccacaggggctgcaacaaagttgtttgtcaaacccagcatgaggaaggtgctgggcagggctgctctgggccacccacagtagacagactaaagatgtcagtctgaagatgcagctcttctttgtcttgccaagataacaccgataagtgacccagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctaggtagcctccccccaacccacccattttgggtaggtgggtagctaagacacagggaaagaggggatcctgcccaagtgaactgtgtgggaagggtttgtggagggattggaaggggtggggagaagccagtatctcccctggggacggggataccatgcccccagggacctttcccccttcaccaactttaatcttgtatttccttttccaaaaagccaagcagaagcaaaagcaggtgagtcaaggaagggacctgggctggggggatcatggcttatggctctggggacagtgttctaggcagtcattgttggagggcagaacagagaggggagggagcccagaacctctggatctgccctgacgccaaccaggcatgagacaggcaccagggccatggtttctactgacctcatgtccattctgcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 2813 - DNA, 1872 bp, Homo sapiens
  ENST00000536187
aggcgtgcaggcgggagcagcgtgcagagcagcggccgggttttgctcccgcctcggagcccctggcccgggggagggggagaggccgctagcctggtctatgtctttttctgactccagtgcaaccttcctgctgaacgagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagca

SEQ ID NO: 2814 - DNA, 581 bp, Homo sapiens
  ENST00000548874
gtgcaggcgggagcagcgtgcagagcagcggccgggttttgctcccgcctcggagcccctggcccgggggagggggagaggccgctagcctggtctatgtctttttctgactccagtgcaaccttcctgctgaacgagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagaggagatctgggaacccttccagcctgagtgacattggcaaccgacgctcccctccgccatctctaggcggaacatgttcccccatatgacgtggtgccctccatgcggcctgtggtgctggtgggaccctctctgaaaggttatgaggtcacagacatgatgcagaaggctctcttcgacttcctcaaacacagattt

SEQ ID NO: 2815 - DNA, 544 bp, Homo sapiens
  ENST00000551716
ggagcagcgtgcagagcagcggccgggttttgctcccgcctcggagcccctggcccgggggagggggagaggccgctagcctggtctatgtctttttctgactccagtgcaaccttcctgctgaacgagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagaggtgatcgacccccctacttccagaagcctctaacttcattttcttgctcttgctccagatcctaatgcttctgacttgaatcctcagtctaattccccaagctaatcagctcttctccttaacacacacctgtccacccctcatatctaagatctcatccccagggtct

SEQ ID NO: 2816 - DNA, 677 bp, Homo sapiens
  ENST00000550168
agcagcgtgcagagcagcggccgggttttgctcccgcctcggagcccctggcccgggggagggggagaggccgctagcctggtctatgtctttttctgactccagtgcaaccttcctgctgaacgagagccatctcccaggagaagagcaccttgagggtcttactctttgacacctctccaggcccctgaaagaaggaattgaagagaaaggatgaaagagggggatacaaggaatactgcgtaactggggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctag

SEQ ID NO: 2817 - DNA, 557 bp, Homo sapiens
  ENST00000552465
agagcagcggccgggttttgctcccgcctcggagcccctggcccgggggagggggagaggccgctagcctggtctatgtctttttctgactccagtgcaaccttcctgctgaacgagagccatctcccaggagaagagcaccttgagggtcttactctttgacacctctccaggcccctgaaagaaggaattgaagagaaaggatgaaagagggggatacaaggaatactgcgtaactgggtgagggcacaaaagtgggcagtgtctgggaacttccaatacagaagaatccagtatatgaccaaaccccagttggtgctggactcaggagaggagacagtcccttcagccacaggggctgcaacaaagttgtttgtcaaacccagcatgaggaaggtgctgggcagggctgctctgggccacccacagtagacagactaaagatgtcagtctgaagatgcagctcttctttgtcttgccaagataacaccgataagtgacccaggtgggaagccacttggtttgggtgggctttctctctcccatgcacagtgctt

SEQ ID NO: 2818 - DNA, 746 bp, Homo sapiens
  ENST00000550064
cggatgccttggcactgtctggcacaatccttggcagggaagtggggaagggaacccccatcctggcaggactaagacaaaatctatccgtgcaacagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaat

SEQ ID NO: 2819 - DNA, 564 bp, Homo sapiens
  ENST00000552022
cctttgtttcccggcggagtagttcctgggttgccgagcgtctctgtctccgcatctctcctcgccccgcctcctccctgcctggatccgccctgcccgcagcctctcctccccttcctccccgccgccacggccccggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctag

SEQ ID NO: 2820 - DNA, 549 bp, Homo sapiens
  ENST00000549971
agttcctgggttgccgagcgtctctgtctccgcatctctcctcgccccgcctcctccctgcctggatccgccctgcccgcagcctctcctccccttcctccccgccgccacggccccgcaagagaggagctgcagcctgcccacacactcactaggcaaggggggcaccaccagggcactgtgccaactcctggcagctccaaagtactgaaactctggctattttggcgtagcagggtacaggaaagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcg

SEQ ID NO: 2821 - DNA, 904 bp, Homo sapiens
  ENST00000547818
gcagcctctcctccccttcctccccgccgccacggccccgtaggtgctcggggacccaccttccacctagcacggggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaag

SEQ ID NO: 2822 - DNA, 2237 bp, Homo sapiens
  ENST00000547392
tccccgccgccacggccccgtaggtgctcggggacccaccttccacctagcacgggttcgttcccctctcccggcctggcccgggctccccggtggccgccgccccctcgccgcccccgccttctcccggggagggggtcaggtgggcgggcactattgttgtaggagccggcgccagattcctcagccgcgctcggggtgggaccggctgggtttgggggggtggggtggggggagcggtgatctgagctccgagcagctggtcttcgcggctcgctccctccttcgcgctctctcgctccctgccgccgcccgcagggctgcggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgaca

SEQ ID NO: 2823 - DNA, 2696 bp, Homo sapiens
  ENST00000301050
gtggggggagcggtgatctgagctccgagcagctggtcttcgcggctcgctccctccttcgcgctctctcgctccctgccgccgcccgcagggctgcggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 2824 - DNA, 576 bp, Homo sapiens
  ENST00000548279
cttcgcgctctctcgctccctgccgccgcccgcagggctgcggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagtacagcaatgactggtggatcgggcggctagtgaaagagggcggggacatcgccttcatccccagcccccagcgcctggagagcatccggctcaaacaggagcagaaggccaggagatctgggaacccttccagcctgagtg

SEQ ID NO: 2825 - DNA, 586 bp, Homo sapiens
  ENST00000550771
gctctctcgctccctgccgccgcccgcagggctgcggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagaggtgatcgacccccctacttccagaagcctctaacttcattttcttgctcttgctccagatcctaatgcttctgacttgaatcctcagtctaattccccaagctaatcagctcttctccttaacacacacctgtccacccctcatatctaagatctcat

SEQ ID NO: 2826 - DNA, 2395 bp, Homo sapiens
  ENST00000547230
tcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 2827 - DNA, 2825 bp, Homo sapiens
  ENST00000551544
tcccccgacccggactcccccatgtatgacgactcctacgtgcccgggtttgaggactcggaggcgccccctgctgaggcttcctctgcagcgggcatcctgagctcttgcccagcatggagggcctggaggtgaggccagaggagctgagggcctggggatggagaggaagcgctttgctcagagaaacaggcaaccgataaatatttaattctcctctttgcttttatctcctgacccactgagacaaatcagctcattaagcagtgattcccggagctcagacagcagggagagtgcctggaaagatggggcaagaatgcggagcagcttctcagccccttggagctgacaactttccctcaaatgtcctggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 2828 - DNA, 1712 bp, Homo sapiens
  ENST00000552812
taattctcctctttgcttttatctcctgacccactgagacaaatcagctcattaagcagtgattcccggagctcagacagcagggagagtgcctggaaagatggggcaagaatgcggagcagcttctcagccccttggagctgacaactttccctcaaatgtcctgtaagaaggcctccttaggagtggaccactagatggcttggaaggggccccaataggttggagcacccctgggtcggaaagaggagttcatgttcaagtcttctcccatcacttactgccaggcccaggatagatgaatgctgatgttcagaataggcaactgtccttttctgggactggtctccttctgggcccaattctccatggggcctctggggctaattacattgccgctagatcagatcattttcaaggctctggtggacacctctttctgacagttgaagggacagctggtatagcccagggtgccaaggtgagcttgaaaacaaacctctctgtggggctggatggccctaggaggttcttcccatccctggtgagaaggcaagggctattgcaaggagcagactgacatgtggatggtgttggagggcagcctgctgacccattgctccctcccatctctctctggctctgatcaccctcccccacttccctttctcttgcctggctccttgctctccctgaggccccctctgaagcagtaggagggagatcaggctctaaataaatccaacggctcatctccctcctctccttcccccgtgccaggcaagagaggagctgcagcctgcccacacactcactaggcaaggggggcaccaccagggcactgtgccaactcctggcagctccaaagtactgaaactctggctattttggcgtagcagggtacaggaaaggtaagaccctagatcatgcttggcagggcagccctggcctccccaagtaatactggagcactagagatgagtgagcctggaggacttgggagtaatggagagggggttccattctgagcacaactcattaaatatttaggaagagatcctgtgattcccatcccagggtgagaggtcaggtaagccagatgcctcaggcgttatgattactaaattaggccgccagcggtgcctcacacctgtaatcccagcactttgggtggccgaggtagatcacttgaggtcaggagttggagaccagcctggccaatatggtgaaaccctgtgtctactaaaaatataaaaattagcccagcatggtggcacatgcctgtagtcccaactactcaggaggctggggcagtagaattgcttgaacccgggaggcagaggttgcagtgagccgacatcgcaccattacattccagcctgggcatcacagtgaaactccatctcaaaaaaaaaaaaaaaattactaaattaaaccaggcatagagactcatgcctataatcccaatgctttgggaggctaaggtaggaagatggcttaagcccaggagtttgagaccagcctaggcaacatagcaagatcctgtctctacaaaaaactagtaggcatggtagcgcatgcctgtagtcgtagctactcaggagacaggaggatcgcttgagcccaggagttcaagcctgcagtgagctacgattgtgccactacactccagcctgggtgacagagcaagacctgtctctaagtaaataaat

SEQ ID NO: 2829 - DNA, 424 bp, Homo sapiens
  ENST00000550190
cagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 2830 - DNA, 730 bp, Homo sapiens
  ENST00000550483
caaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattggcttcgatgaatgcccttttcctccaattccttcctgtccaccattcgggagccctcaaagcctgctggagtgagcagtgggcagagctcctggtgagcactgctgctgcctccctccatagcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaag

SEQ ID NO: 2831 - DNA, 927 bp, Homo sapiens
  ENST00000552480
acaggcaccagggccatggtttctactgacctcatgtccattctgcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcg

SEQ ID NO: 2832 - DNA, 8378 bp, Homo sapiens
  ENST00000539935
acacacacacacacacccgctcggttcttcccattcccgccacactgcaccagcttccgtccccaagtcctgattcatgaaccgtgccacctttgtctcattttaaactgtgcagactattttaatcttgccacccccatcccagatttccccctcccttcatcctctggaagctctgatgtaaagcgcttgctaggtgggagagcgcttctcccaatccgctcgggtaggcgagtttccgagaagccccctccccgggaccccgccgcgagcgcgggggaagcgcctcggtccctttaaggtgccgcgctctccgaagtgcgggcagggagcctgggcgccggcgcgggtcctggagccgggtggggaagtcctgcgccctccccctccgtccgcagcccagcctcgggggccagccccctccgcccaccgcacacgggctggccatgcggcggctctgaacgatgtcctcctcctcctacgccaagaacgggaccgcggacgggccgcactcccccacctcgcaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccaccgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcataccatattttctcctcttatttcttctctttcaataacaacagcagaaagtcacagcaagtgagctcatagggctcctctgaattttggacatgtgtgagatttttgtatttttcacagcctcgagtcagaatgatcaataaagatgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgttttgttctccctctgctttagtggctttaaagaaaaaaacgtggtgttatttttgtgaataaaaacattaacaaagaaaatgcagagtgcatgcatagagtatcctcatttctatggatttgttttatggaatttaaatgtgtacaaaacaactgcattactttttttcttttatataataaatgaaaaaaacactgaaacca

SEQ ID NO: 2833 - DNA, 7658 bp, Homo sapiens
  ENST00000637547
gtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtggaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccaccgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcataccatattttctcctcttatttcttctctttcaataacaacagcagaaagtcacagcaagtgagctcatagggctcctctgaattttggacatgtgtgagatttttgtatttttcacagcctcgagtcagaatgatcaataaagatgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgttttgttctccctctgctttagtggctttaaagaaaaaaacgtggtgttatttttgtgaataaaaacattaacaaagaaaatgcagagtgcatgcatagagtatcctcatttctatggatttgttttatggaatttaaatgtgtacaaaacaactgcattactttttt

SEQ ID NO: 2834 - DNA, 7706 bp, Homo sapiens
  ENST00000636901
gtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccaccgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcataccatattttctcctcttatttcttctctttcaataacaacagcagaaagtcacagcaagtgagctcatagggctcctctgaattttggacatgtgtgagatttttgtatttttcacagcctcgagtcagaatgatcaataaagatgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgttttgttctccctctgctttagtggctttaaagaaaaaaacgtggtgttatttttgtgaataaaaacattaacaaagaaaatgcagagtgcatgcatagagtatcctcatttctatggatttgttttatggaatttaaatgtgtacaaaacaactgcatt

SEQ ID NO: 2835 - DNA, 7854 bp, Homo sapiens
  ENST00000635738
gctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccaccgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcataccatattttctcctcttatttcttctctttcaataacaacagcagaaagtcacagcaagtgagctcatagggctcctctgaattttggacatgtgtgagatttttgtatttttcacagcctcgagtcagaatgatcaataaagatgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgttttgttctccctctgctttagtggctttaaagaaaaaaacgtggtgttatttttgtgaataaaaacattaacaaagaaaatgcagagtgcatgcatagagtatcctcatttctatggatttgttttatggaatttaaatgtgtacaaaaca

SEQ ID NO: 2836 - DNA, 7748 bp, Homo sapiens
  ENST00000636130
agtagttgatggcgggtagtgctaggtactgcagtgctgtactcctggtgactcagtggtggccagcaggctgagatcctccgggctgtgcacatctgtggaggaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccaagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccaccgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcataccatattttctcctcttatttcttctctttcaataacaacagcagaaagtcacagcaagtgagctcatagggctcctctgaattttggacatgtgtgagatttttgtatttttcacagcctcgagtcagaatgatcaataaagatgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgttttgttctccctctgctttagtggctttaaagaaaaaaacgtggtgttatttttgtgaataaaaacattaacaaagaaaatgcagagtgcatgcatagagtatcctc

SEQ ID NO: 2837 - DNA, 8188 bp, Homo sapiens
  ENST00000637217
ctgactgaagcagggaagccgagccaatcagaggccgctttcctagctcagtcaccagtctgtggttgaggaagggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccaccgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcataccatattttctcctcttatttcttctctttcaataacaacagcagaaagtcacagcaagtgagctcatagggctcctctgaattttggacatgtgtgagatttttgtatttttcacagcctcgagtcagaatgatcaataaagatgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgttttgttctccctctgctttagtggctttaaagaaaaaaacgtggtgttatttttgtgaataaaaacattaacaaagaaaatgcagagtgcatgcatagagtatcc

SEQ ID NO: 2838 - DNA, 7409 bp, Homo sapiens
  ENST00000637309
gctctccgaagtgcgggcagggagcctgggcgccggcgcgggtcctggagccgggtggggaagtcctgcgccctccccctccgtccgcagcccagcctcgggggccagccccctccgcccaccgcacacgggctggccatgcggcggctctgaacgatgtcctcctcctcctacgccaagaacgggaccgcggacgggccgcactcccccacctcgcaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccaccgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcataccatattttctcctcttatttcttctctttcaataacaacagcagaaagtcacagcaagtgagctcatagggctcctctgaattttggacatgtgtgagatttttgtatttttcacagcctcgagtcagaatgatcaataaagatgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgttttgttctccctctgctttagtggctttaaagaaaaaaacgtggtgttatttttgtgaataaaaacattaacaaagaaaatgcaga

SEQ ID NO: 2839 - DNA, 7654 bp, Homo sapiens
  ENST00000636350
gccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttcatgtcttcttctatcaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccaccgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcataccatattttctcctcttatttcttctctttcaataacaacagcagaaagtcacagcaagtgagctcatagggctcctctgaattttggacatgtgtgagatttttgtatttttcacagcctcgagtcagaatgatcaataaagatgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgttttgttctccctctgctttagtggctttaaagaaaaaaacgtggtgttatttttgtgaataa

SEQ ID NO: 2840 - DNA, 7808 bp, Homo sapiens
  ENST00000636598
acataaatcaggggaagagagagatgttcggaggggtgaactgactctgaatgctcatttgagtttatttgtttttataaggaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccaccgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcataccatattttctcctcttatttcttctctttcaataacaacagcagaaagtcacagcaagtgagctcatagggctcctctgaattttggacatgtgtgagatttttgtatttttcacagcctcgagtcagaatgatcaataaagatgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgtttt

SEQ ID NO: 2841 - DNA, 8595 bp, Homo sapiens
  ENST00000636831
attgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacaggtgagggttgtagttaaactctttttcatacactgtattccttttaaaaatatttgaacacacatgcaagtagttttgctaatttggaaacaatttgaaggcttaatttaaagattctctaattaatatttcatttctcatttgttttctatggtaatttgatttcatttaaaatggtattaaaaattcatgtcattagaatataattttgaaaaatcttatttacccctcagtgttaataactgtccattgtgtaaattgatattcaaaaaattcattattttacctaaggaacggacagagtttaagatggtgaaggccaataaaaaaaggaaaaaaatgatgcagactctcaagaaaatgctgttttcagtctccatgtggaatttcaggatgtattagtacagcccgagctggaagggttgaagcagagagtaaggcagggcccaaaggagggagggcctcgtttacatttggacagcagacagccaagccctggaattaatggtaatgaagagatattggtggcctaatagggaattgtggtacatttggaaacgatggagttattcatgtaggaatttttcttctaccacattccctgattcctatcggctaatttcattctggcctagaactgctgttgcattagggcatccagtgtcctagttaccaattccaattgtattaccaatttggaatggcaagtccaaggccctattctggcctaccaaaactggaggcaactggattggttctggagtggttctaagtgtctgggtccttgttcatgtgaagccctcttatctacaggacactgaaccaaaccaggtttctgagttgtacccaactagactggagctgcttggatgtccacagaatcgctttaaatcagttattgagtatattttgcttcgttcccatttgttggacattcaggacattgaacactttagctattacaaacaggaaagaacaggaataactcattataaatttatctgaggaataactggttataaatgtatttgaaatttagaagcaagatagtaggaaaaatgtgccaatattctagaaaatgggcaaaaatgcccaagggactgcagaattatgagttaacaaatataaaaataactattgattgaggtgatagtcatttttgcccaagtggttattctgtttccttttatgaaattgcatttgtctaccttgttcccagcaacactgtgctgtgtccagcacgggaacaacccatggtgattggctggcccggaacttccagtgttgctctcaactcctgtacccaattcccacccagtgagaaatcaggatataaggtcatttgtaccagggaggaagctgtctgtttttcatacatcttcaaaattgacgtgtccagaatgaaatcataaggcaggttctccaaagtgggcgataggaaggtggtgaagataattacagggacaaatgggtacattcttccatcttttaaactcatgtactgtcatttgcagagtttacatattttgatatggctctcgttattgtcttttagcaaaacagaagcaaaaagtggtaagttgtgtttcctttttaaatctactgttaaggttcctatatatacatgcctgcaatgctccatttcagtgacccaagtggctataaaataagggaagagcctcctcggtggggactttgataatcatttgtcgttcaacctgagaattatgaaattatgaatgttgtggctgtggagaggcatgctcaacctcaccttgtcacgcgtgtcgaatcatctttttcagacggagcacattcctccttacgatgttgtaccgtcaatgcgtccggtggtgttagtggggccgtcactgaaaggttacgagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataa

SEQ ID NO: 2842 - DNA, 5757 bp, Homo sapiens
  ENST00000636617
gctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagt

SEQ ID NO: 2843 - DNA, 3567 bp, Homo sapiens
  ENST00000635890
gcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccatcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtc

SEQ ID NO: 2844 - DNA, 4615 bp, Homo sapiens
  ENST00000638005
gtcccgggagtcggcggccccgctccccccacccctcctccacgtccctttctcctcccgctcctcctctttctcctccttctcttcctcctcctcctcaccctccttcgggtctctgcgctcccgctccggagcccgcagcctcccccagcggatgccggggactcggaccccgcaccctgagagtctttgttaatggatgtggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcaca

SEQ ID NO: 2845 - DNA, 4688 bp, Homo sapiens
  ENST00000636507
gggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacat

SEQ ID NO: 2846 - DNA, 4024 bp, Homo sapiens
  ENST00000637232
gctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaa

SEQ ID NO: 2847 - DNA, 4484 bp, Homo sapiens
  ENST00000635930
ggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctgtttattacacaaaccgagggatgttcttatggggatccatggacgcagcagagaaagttaccaaaaacctaccacccagaaatagtcattgttaatatattgctacacaccctttcagatgatcaatccacatatatgtaaatagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatct

SEQ ID NO: 2848 - DNA, 4232 bp, Homo sapiens
  ENST00000636442
ctcctccacgtccctttctcctcccgctcctcctctttctcctccttctcttcctcctcctcctcaccctccttcgggtctctgcgctcccgctccggagcccgcagcctcccccagcggatgccggggactcggaccccgcaccctgagagtctttgttaatggatgtggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttat

SEQ ID NO: 2849 - DNA, 3787 bp, Homo sapiens
  ENST00000636785
gcagcctcccccagcggatgccggggactcggaccccgcaccctgagagtctttgttaatggatgtggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctc

SEQ ID NO: 2850 - DNA, 4061 bp, Homo sapiens
  ENST00000638091
tgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccaagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatg

SEQ ID NO: 2851 - DNA, 4143 bp, Homo sapiens
  ENST00000636773
agtcaccagtctgtggttgaggaagggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccaagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctc

SEQ ID NO: 2852 - DNA, 4020 bp, Homo sapiens
  ENST00000637942
gctggaactacaggcatgtgccactgtgcctggctagtttttgtattttagtagagacggaggttcaccttgttggccaggctggtcttgaactcctgacctcaaatgatccacccatgtcggcctcccaaagtgctgggattacaggcatgagccaccatgccaggccctgctttattcttctcttgcatgaccgaaggatactttctaacgtagaaaatcctggcacaatactcacattactttcaactagagtgccttatgactgcccaccgtatgcattcaaagtcttatgcaaatatgctgaagaatcttatgcatgcagaaaaaataaaaccattttttcacattcttataaatgaagtatccctttgggcctgtggagaatcacgtgtgtatcacaaaagaatgcagcttagccacagactggtagattgtctttgataatcaaaatgaagagggtttcccagctttgactggcatcattaaatgccagagcaaagcatttgtagttcctgaaggtcttgttcaagagcaaatcaactatgaattgtggcaaattgtattgctacttcctagaaagagcatggtttatttatatgtcttgattccttcctggtgtggtgtatattataaagggaattcagcaaggcaggccataatggaggaagaacatttttactggagtaggtttttttgtgtgtgaaacagtttaaaccttcctccattctgctctgcttgcattctgatactagccagagcctgtttaaaatacttgtggccaatgtttgttatactgtggttcccctgtagcatgtaaattggttattaagtactgtggttataaatcacttggagagccccataacatttttactggcttgttctgttctgtgttcctattcataggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggta

SEQ ID NO: 2853 - DNA, 3877 bp, Homo sapiens
  ENST00000637132
gttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaa

SEQ ID NO: 2854 - DNA, 3800 bp, Homo sapiens
  ENST00000637762
gggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggctttttgtggcatctcttgtctcctggtatttgggtgaagacagcttcaggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgt

SEQ ID NO: 2855 - DNA, 3038 bp, Homo sapiens
  ENST00000637550
agctcagtcaccagtctgtggttgaggaagggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaa

SEQ ID NO: 2856 - DNA, 3485 bp, Homo sapiens
  ENST00000637312
ggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggata

SEQ ID NO: 2857 - DNA, 3520 bp, Homo sapiens
  ENST00000637436
tgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctcttacaaaacagttgggagttgggagaatctccaaaacagagattggattgctctctgacccaaatgggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgagga

SEQ ID NO: 2858 - DNA, 3395 bp, Homo sapiens
  ENST00000635803
agtctgtggttgaggaagggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgtctttgactgagattccctaaggaagtggcaaagaagcagaatgtgctatgatctctgaatgttcctgggagactaaacatgatctttccttgcaagaaagtcacagttctctgtgtaataaacagagttggctgctccccagaattctccagtcaaggattactatctgcgagctgtttgaacttctgctccttgggaaattaagggttcagcggattcctacacaagcaggccgtctgactccgatgtctctttggaagaggaccgggaagcaattcgacaggagagagaacagcaagcagctatccagcttgagagagcaaagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacc

SEQ ID NO: 2859 - DNA, 3191 bp, Homo sapiens
  ENST00000636762
ggagcccgcagcctcccccagcggatgccggggactcggaccccgcaccctgagagtctttgttaatggatgtggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagagtttacatattttgatatggctctcgttattgtcttttagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgct

SEQ ID NO: 2860 - DNA, 2369 bp, Homo sapiens
  ENST00000534999
gaggccgctttcctagctcagtcaccagtctgtggttgaggaagggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaa

SEQ ID NO: 2861 - DNA, 2034 bp, Homo sapiens
  ENST00000637913
gctgcggtcctcaccggcttctctctggcccccgtgtgtcgagtccaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagcc

SEQ ID NO: 2862 - DNA, 2423 bp, Homo sapiens
  ENST00000637284
tgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctgtttattacacaaaccgagggatgttcttatggggatccatggacgcagcagagaaagttaccaaaaacctaccacccagaaatagtcattgttaatatattgctacacaccctttcagatgatcaatccacatatatgtaaatagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatc

SEQ ID NO: 2863 - DNA, 2159 bp, Homo sapiens
  ENST00000439467
cacaggacagctgagtttttctgtaagatgggaagtgaagagtgcagtgacttgactcggtggcagtagttgatggcgggtagtgctaggtactgcagtgctgtactcctggtgactcagtggtggccagcaggctgagatcctccgggctgtgcacatctgtggaggaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgt

SEQ ID NO: 2864 - DNA, 3549 bp, Homo sapiens
  ENST00000637319
gtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtacaaatatcatctgttactcttcagttcttgatcgagcacccaggagacagtcatgttgacgcttgctcctcaagggtctgtttccacgtgggtcctgatggaagccagtgctcagcatgggaaggcagggggtaccgtgtggggctcatgaggccctctgccctttctttcctctcttgcacacttctcatcttttatgtattacattgtttagaaatacctccctcaaaatattcacaatgggaagatctggtcaaagatttgctgtacattaaatgcaaagaaaaggactttatctgtcttgaccattctcattattattagaagtaatagagaatgaacagcacaagaggacaaacaatcaatcttccagcaaacccaaacctttaaagcccaaacagagttcaccctgctgggtttttaagatgatggcatatgccaccaaatccttctctgcttatttattttaaagggcacatgttttaaaagaccactaaaaacattagtgaactttggagattaaacaaaaccatgtgacaaggaaaagagtagagacttcgtttcagatgtttgttttgactttgtgctagcttggattaaaaaataggtagaacgtgacattaaactctgaaggtgagcagcctccagggcaccattcccatcgagctaggacaatgtgtggcacatagtaggcactcagtacacatttgctgaatgaattaatgaatcgctttcaggcagatctaagaatcctggctctatccccctctctttctctcttgtctttctcagagttggaaatgtcagagggatgagcaggagagtggtctacaaaaatccagccatgggcatggagaatttccgccaacatacacaaactagcaggaaggctgagtccagtgctggcctcagttctctagctgctcctcactggaggcaggcacaactcaggcgtgccaaggatacccggcacctgtgtacaaagccagcctgttgtctcctggcagcagttctatcccctaacgagggaagagggaagagggaagagggtctggtgaacactgctggtttattcctcaacaccctggaggagaaccaaggggggtggaaattagcaattgcacatggttaagcatgaaaaacaccttccatggtaacctccccctaggagacgaatggctacaataaggtcttggctcatagtacccttccctccctcctctctcccttttgacttctctctctctctctgcatgtgtttgcctcattctttttttctcacctctgcaaaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagca

SEQ ID NO: 2865 - DNA, 2015 bp, Homo sapiens
  ENST00000637418
agtcaccagtctgtggttgaggaagggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagc

SEQ ID NO: 2866 - DNA, 2112 bp, Homo sapiens
  ENST00000397327
gtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaa

SEQ ID NO: 2867 - DNA, 2102 bp, Homo sapiens
  ENST00000637330
gtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttata

SEQ ID NO: 2868 - DNA, 2026 bp, Homo sapiens
  ENST00000638040
gtctgtggttgaggaagggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagacggagcacattcctccttacgatgttgtaccgtcaatgcgtccggtggtgttagtggggccgtcactgaaaggttacgagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgacc

SEQ ID NO: 2869 - DNA, 1776 bp, Homo sapiens
  ENST00000427385
ggccatgcggcggctctgaacgatgtcctcctcctcctacgccaagaacgggaccgcggacgggccgcactcccccacctcgcaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcc

SEQ ID NO: 2870 - DNA, 1542 bp, Homo sapiens
  ENST00000636721
gtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataa

SEQ ID NO: 2871 - DNA, 1698 bp, Homo sapiens
  ENST00000636664
ggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttaca

SEQ ID NO: 2872 - DNA, 1772 bp, Homo sapiens
  ENST00000637779
gggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagacggagcacattcctccttacgatgttgtaccgtcaatgcgtccggtggtgttagtggggccgtcactgaaaggttacgagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggt

SEQ ID NO: 2873 - DNA, 1756 bp, Homo sapiens
  ENST00000636380
gtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaattta

SEQ ID NO: 2874 - DNA, 1698 bp, Homo sapiens
  ENST00000636108
gggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcat

SEQ ID NO: 2875 - DNA, 1731 bp, Homo sapiens
  ENST00000637535
gtggttgaggaagggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattaga

SEQ ID NO: 2876 - DNA, 1751 bp, Homo sapiens
  ENST00000637491
gtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgct

SEQ ID NO: 2877 - DNA, 2444 bp, Homo sapiens
  ENST00000635904
aggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgagagttggaaatgtcagagggatgagcaggagagtggtctacaaaaatccagccatgggcatggagaatttccgccaacatacacaaactagcaggaaggctgagtccagtgctggcctcagttctctagctgctcctcactggaggcaggcacaactcaggcgtgccaaggatacccggcacctgtgtacaaagccagcctgttgtctcctggcagcagttctatcccctaacgagggaagagggaagagggaagagggtctggtgaacactgctggtttattcctcaacaccctggaggagaaccaaggggggtggaaattagcaattgcacatggttaagcatgaaaaacaccttccatggtaacctccccctaggagacgaatggctacaataaggtcttggctcatagtacccttccctccctcctctctcccttttgacttctctctctctctctgcatgtgtttgcctcattctttttttctcacctctgcaaaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgc

SEQ ID NO: 2878 - DNA, 3754 bp, Homo sapiens
  ENST00000636810
gtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacaggtgagggttgtagttaaactctttttcatacactgtattccttttaaaaatatttgaacacacatgcaagtagttttgctaatttggaaacaatttgaaggcttaatttaaagattctctaattaatatttcatttctcatttgttttctatggtaatttgatttcatttaaaatggtattaaaaattcatgtcattagaatataattttgaaaaatcttatttacccctcagtgttaataactgtccattgtgtaaattgatattcaaaaaattcattattttacctaaggaacggacagagtttaagatggtgaaggccaataaaaaaaggaaaaaaatgatgcagactctcaagaaaatgctgttttcagtctccatgtggaatttcaggatgtattagtacagcccgagctggaagggttgaagcagagagtaaggcagggcccaaaggagggagggcctcgtttacatttggacagcagacagccaagccctggaattaatggtaatgaagagatattggtggcctaatagggaattgtggtacatttggaaacgatggagttattcatgtaggaatttttcttctaccacattccctgattcctatcggctaatttcattctggcctagaactgctgttgcattagggcatccagtgtcctagttaccaattccaattgtattaccaatttggaatggcaagtccaaggccctattctggcctaccaaaactggaggcaactggattggttctggagtggttctaagtgtctgggtccttgttcatgtgaagccctcttatctacaggacactgaaccaaaccaggtttctgagttgtacccaactagactggagctgcttggatgtccacagaatcgctttaaatcagttattgagtatattttgcttcgttcccatttgttggacattcaggacattgaacactttagctattacaaacaggaaagaacaggaataactcattataaatttatctgaggaataactggttataaatgtatttgaaatttagaagcaagatagtaggaaaaatgtgccaatattctagaaaatgggcaaaaatgcccaagggactgcagaattatgagttaacaaatataaaaataactattgattgaggtgatagtcatttttgcccaagtggttattctgtttccttttatgaaattgcatttgtctaccttgttcccagcaacactgtgctgtgtccagcacgggaacaacccatggtgattggctggcccggaacttccagtgttgctctcaactcctgtacccaattcccacccagtgagaaatcaggatataaggtcatttgtaccagggaggaagctgtctgtttttcatacatcttcaaaattgacgtgtccagaatgaaatcataaggcaggttctccaaagtgggcgataggaaggtggtgaagataattacagggacaaatgggtacattcttccatcttttaaactcatgtactgtcatttgcagagtttacatattttgatatggctctcgttattgtcttttagcaaaacagaagcaaaaagtggtaagttgtgtttcctttttaaatctactgttaaggttcctatatatacatgcctgcaatgctccatttcagtgacccaagtggctataaaataagggaagagcctcctcggtggggactttgataatcatttgtcgttcaacctgagaattatgaaattatgaatgttgtggctgtggagaggcatgctcaacctcaccttgtcacgcgtgtcgaatcatctttttcagacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgc

SEQ ID NO: 2879 - DNA, 3104 bp, Homo sapiens
  ENST00000637530
gtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtacaaatatcatctgttactcttcagttcttgatcgagcacccaggagacagtcatgttgacgcttgctcctcaagggtctgtttccacgtgggtcctgatggaagccagtgctcagcatgggaaggcagggggtaccgtgtggggctcatgaggccctctgccctttctttcctctcttgcacacttctcatcttttatgtattacattgtttagaaatacctccctcaaaatattcacaatgggaagatctggtcaaagatttgctgtacattaaatgcaaagaaaaggactttatctgtcttgaccattctcattattattagaagtaatagagaatgaacagcacaagaggacaaacaatcaatcttccagcaaacccaaacctttaaagcccaaacagagttcaccctgctgggtttttaagatgatggcatatgccaccaaatccttctctgcttatttattttaaagggcacatgttttaaaagaccactaaaaacattagtgaactttggagattaaacaaaaccatgtgacaaggaaaagagtagagacttcgtttcagatgtttgttttgactttgtgctagcttggattaaaaaataggtagaacgtgacattaaactctgaaggtgagcagcctccagggcaccattcccatcgagctaggacaatgtgtggcacatagtaggcactcagtacacatttgctgaatgaattaatgaatcgctttcaggcagatctaagaatcctggctctatccccctctctttctctcttgtctttctcagagttggaaatgtcagagggatgagcaggagagtggtctacaaaaatccagccatgggcatggagaatttccgccaacatacacaaactagcaggaaggctgagtccagtgctggcctcagttctctagctgctcctcactggaggcaggcacaactcaggcgtgccaaggatacccggcacctgtgtacaaagccagcctgttgtctcctggcagcagttctatcccctaacgagggaagagggaagagggaagagggtctggtgaacactgctggtttattcctcaacaccctggaggagaaccaaggggggtggaaattagcaattgcacatggttaagcatgaaaaacaccttccatggtaacctccccctaggagacgaatggctacaataaggtcttggctcatagtacccttccctccctcctctctcccttttgacttctctctctctctctgcatgtgtttgcctcattctttttttctcacctctgcaaaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgc

SEQ ID NO: 2880 - DNA, 1885 bp, Homo sapiens
  ENST00000360283
actctccgagggaacgctcttcagctgactgaagcagggaagccgagccaatcagaggccgctttcctagctcagtcaccagtctgtggttgaggaagggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgc

SEQ ID NO: 2881 - DNA, 1880 bp, Homo sapiens
  ENST00000637514
gtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctcctgagcatcatataggaaaaagattctgaccttctacgttattactctattggcagctttgttgaaaagtttgggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgt

SEQ ID NO: 2882 - DNA, 1646 bp, Homo sapiens
  ENST00000638150
gtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgt

SEQ ID NO: 2883 - DNA, 1430 bp, Homo sapiens
  ENST00000637956
gaactgactctgaatgctcatttgagtttatttgtttttataaggaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctcctgagcatcatataggaaaaagattctgaccttctacgttattactctattggcagctttgttgaaaagtttgggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccaagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcaca

SEQ ID NO: 2884 - DNA, 858 bp, Homo sapiens
  ENST00000637007
ttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagacggagcacattcctccttacgatgttgtaccgtcaatgcgtccggtggtgttagtggggccgtcactgaaaggttacgaggaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcac

SEQ ID NO: 2885 - DNA, 1831 bp, Homo sapiens
  ENST00000637828
agtagttgatggcgggtagtgctaggtactgcagtgctgtactcctggtgactcagtggtggccagcaggctgagatcctccgggctgtgcacatctgtggaggaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagaaaactacccagagactgacaatttcctgagaattatgctgtctgtgaatttacagtggattttacttagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggct

SEQ ID NO: 2886 - DNA, 2955 bp, Homo sapiens
  ENST00000637765
gtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtacaaatatcatctgttactcttcagttcttgatcgagcacccaggagacagtcatgttgacgcttgctcctcaagggtctgtttccacgtgggtcctgatggaagccagtgctcagcatgggaaggcagggggtaccgtgtggggctcatgaggccctctgccctttctttcctctcttgcacacttctcatcttttatgtattacattgtttagaaatacctccctcaaaatattcacaatgggaagatctggtcaaagatttgctgtacattaaatgcaaagaaaaggactttatctgtcttgaccattctcattattattagaagtaatagagaatgaacagcacaagaggacaaacaatcaatcttccagcaaacccaaacctttaaagcccaaacagagttcaccctgctgggtttttaagatgatggcatatgccaccaaatccttctctgcttatttattttaaagggcacatgttttaaaagaccactaaaaacattagtgaactttggagattaaacaaaaccatgtgacaaggaaaagagtagagacttcgtttcagatgtttgttttgactttgtgctagcttggattaaaaaataggtagaacgtgacattaaactctgaaggtgagcagcctccagggcaccattcccatcgagctaggacaatgtgtggcacatagtaggcactcagtacacatttgctgaatgaattaatgaatcgctttcaggcagatctaagaatcctggctctatccccctctctttctctcttgtctttctcagagttggaaatgtcagagggatgagcaggagagtggtctacaaaaatccagccatgggcatggagaatttccgccaacatacacaaactagcaggaaggctgagtccagtgctggcctcagttctctagctgctcctcactggaggcaggcacaactcaggcgtgccaaggatacccggcacctgtgtacaaagccagcctgttgtctcctggcagcagttctatcccctaacgagggaagagggaagagggaagagggtctggtgaacactgctggtttattcctcaacaccctggaggagaaccaaggggggtggaaattagcaattgcacatggttaagcatgaaaaacaccttccatggtaacctccccctaggagacgaatggctacaataaggtcttggctcatagtacccttccctccctcctctctcccttttgacttctctctctctctctgcatgtgtttgcctcattctttttttctcacctctgcaaaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaact

SEQ ID NO: 2887 - DNA, 1389 bp, Homo sapiens
  ENST00000201943
cggctctgaacgatgtcctcctcctcctacgccaagaacgggaccgcggacgggccgcactcccccacctcgcaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccaagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttga

SEQ ID NO: 2888 - DNA, 3174 bp, Homo sapiens
  ENST00000637773
gtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacaggtgagggttgtagttaaactctttttcatacactgtattccttttaaaaatatttgaacacacatgcaagtagttttgctaatttggaaacaatttgaaggcttaatttaaagattctctaattaatatttcatttctcatttgttttctatggtaatttgatttcatttaaaatggtattaaaaattcatgtcattagaatataattttgaaaaatcttatttacccctcagtgttaataactgtccattgtgtaaattgatattcaaaaaattcattattttacctaaggaacggacagagtttaagatggtgaaggccaataaaaaaaggaaaaaaatgatgcagactctcaagaaaatgctgttttcagtctccatgtggaatttcaggatgtattagtacagcccgagctggaagggttgaagcagagagtaaggcagggcccaaaggagggagggcctcgtttacatttggacagcagacagccaagccctggaattaatggtaatgaagagatattggtggcctaatagggaattgtggtacatttggaaacgatggagttattcatgtaggaatttttcttctaccacattccctgattcctatcggctaatttcattctggcctagaactgctgttgcattagggcatccagtgtcctagttaccaattccaattgtattaccaatttggaatggcaagtccaaggccctattctggcctaccaaaactggaggcaactggattggttctggagtggttctaagtgtctgggtccttgttcatgtgaagccctcttatctacaggacactgaaccaaaccaggtttctgagttgtacccaactagactggagctgcttggatgtccacagaatcgctttaaatcagttattgagtatattttgcttcgttcccatttgttggacattcaggacattgaacactttagctattacaaacaggaaagaacaggaataactcattataaatttatctgaggaataactggttataaatgtatttgaaatttagaagcaagatagtaggaaaaatgtgccaatattctagaaaatgggcaaaaatgcccaagggactgcagaattatgagttaacaaatataaaaataactattgattgaggtgatagtcatttttgcccaagtggttattctgtttccttttatgaaattgcatttgtctaccttgttcccagcaacactgtgctgtgtccagcacgggaacaacccatggtgattggctggcccggaacttccagtgttgctctcaactcctgtacccaattcccacccagtgagaaatcaggatataaggtcatttgtaccagggaggaagctgtctgtttttcatacatcttcaaaattgacgtgtccagaatgaaatcataaggcaggttctccaaagtgggcgataggaaggtggtgaagataattacagggacaaatgggtacattcttccatcttttaaactcatgtactgtcatttgcagagtttacatattttgatatggctctcgttattgtcttttagcaaaacagaagcaaaaagtggtaagttgtgtttcctttttaaatctactgttaaggttcctatatatacatgcctgcaatgctccatttcagtgacccaagtggctataaaataagggaagagcctcctcggtggggactttgataatcatttgtcgttcaacctgagaattatgaaattatgaatgttgtggctgtggagaggcatgctcaacctcaccttgtcacgcgtgtcgaatcatctttttcagacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctc

SEQ ID NO: 2889 - DNA, 1292 bp, Homo sapiens
  ENST00000637216
tcagtcaccagtctgtggttgaggaagggttttgctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggaaatgtttgatgttatattggatgaaaatcagcttgaggatgcatgtgaacatctaggggagtacctggaggcgtactggcgtgccacccacacaaccagtagcac

SEQ ID NO: 2890 - DNA, 4299 bp, Homo sapiens
  ENST00000635731
aactgccaaccagcatggcagtcttctctcatgggtggagaatgtctaaagaagctgtactctcctccagatgttctgagatcctagccttccatctatctctgcagacactgctttggtgcagtggacttgggaatcctgaacaaactagggccttttgagaatcagtagaatggattgaaagagctgctgggggttcaagcacttcactgcagtgcaggagagttcagcccttcccactgcccatgacactgtggtgtccttaagtgcaagaacaggagttcccagacacctatgtcctggggtattatagagctcatagattagcattgtttgcaggggaagggccacgggacatggcagtatatgaccaaatgcagttacagcagtggccaaaagacatagatatatcactggtttacatgtagcaatatactaatacaaatgttttgcctgggtctccaatcacagaatagtctgattaatttaaaattaaactgaaatgtcccattaataatcggtgacaaaaataaccagaaaatgactctgacatttatctgacatggagatagtgagctaaaacattattcaggtgaataatattaaagtattacttaacataaatgacctggtacagtccactccctccatttttacaggtctctctttgaaatctctgggaaaaatctaggatgggaactcaggctcctcctgagacttcacacagagttagaataggatgaacatatcaaatccatggaactgagagccaatgtaagcagatgacatcattacaggtttaaatatatgatttctcacactgcatttcctctctgataatactcagggccaagcagaccattaaaaagatcctggcttatttgattttctttcaactcatctacaatacctcaggttcatgtcttcttctatcaggttttacagcggttgattaaatctagaggaaagtcacaaagtaaacacttgaatgttcaactggtggcagctgataaacttgcacaatgccccccagtaagtatgatcattttttgtcttcatcattcttgactagttagaagagggtgggtttttttttcttcatattgttgttttcattctaaaatgatggtgatgatggtatgttgtcatctaaaagatttcttggaacaaactgctgctgttatgttgcttgtattcaggcatccagatgtggatggtgtttgccttgtaataagaaatgaacttagtgtccggggtctgttcttctcactgctaccttgtttgctttgcaaacatgcagcaaaccacttagcattcagcctccagtcacatggatacgcttaagaaaagaacaaaagaaaacataccaatttgatcttcctttaactcttctgcaagaaaattccagcaggcataaaagattatgacactgaaggtcaagaattgattggaactagagaggccctgtggttatagtagatgaaagagtcagggctgagtcagatgaaaaacgaaattatagcaactcttcttctagtgccattgccagaaaacagctgctgggttagaaggtgagcaatggtgggatggggtgggagatggaactgctatcacatggcactgggtccccagtggccagtctctccacttttcccactgacttactatttctgtgcctatgtttctgtaaaggaaataactgtccttcttactcaatggattcactagattgttttatacacttgtgtaggattgtttaagctctatggaagcatgaaatctgattcaaatgtttagagagggcaacacagcataacctgtaaaagcacagactctggagccagatatttgggttttgaatccacactgactagttatgtaatcttgggcaagtacctatctcatgggattggtgtaaggattgagtgagtgaatatgtggtaaagctgttagaacagcgccaggaacataagaagcaccgtctaagttttcttattataattactggatacactttgtgtgacgtcatgtctggtccagtagactctgtaagaacccgtgcccctctggctcactgttgtatgtcagttccctatcatagtagacccataatatatatttgtggaatgagtgaataaatgaaaggatgttcagacgataagagtaataatgcatcctttcattagatgcttacagttggccacacagtgtgctagatgctttacatagattatctctaatcttcacagttacctggtgagataggccatattatctccattttatagtttaggcaactgaaaacagagacattaaacgatttccctaaggtgacatagcaaattaggattcaatctattctagatctatctggctccaaagacaatttcctaccccctaacccatccacccatacacacatgtacctggttacctaccctgaagataatttgatagcttggagcatggcgtgctctgttaagtttcacttcacgctgcctgttagtgaagcccaattacacagtggaatgtatgattaaggcactgaacagacagaggaatgtattgcccagccctgaccttctaatgtttcacagttgaaggaagataatctttgttgtctagctatcaaaagccgggaactatgttattatttccaatttttggaacaatcttataaggatagttatatcagtttggtcttctgggaagcagacacctaaatggaattacaaatgcaagagatttattggagaaattttatctttatgaaaataagtttattaacatttattctaataattactagagaaaattcttgtgtcctattaaatttgagggattttagctgctgagagggttgatcattgagtagttgtacatataatatggtttgttacatctgaaatagctggaatcaagaaaagatatttgcatctgtaaaagcaactaatatactgagctaccttaggacttgtacccaggtcagagatttcaaacagctccatgactggaaagacagccttgccttaccattatctcagtaggataaacactttatctttttatataattggtaagataacctggaattttaaacaggcagtctggatggataaggttaccttgtacttagcattttctaaacactgtttactttattaaacatgttcaattgatactgcacagatgtagtaatgctgaggaggaatagtatcctctattttggcatgtgtgaagaaatctttggattataaaaaccagtagtaaccttaaaatgtgtctgcatttgcccctgctttacttcaagaccataattataattgtcatccaaagattggtgatcactgtgtcattttaattcctttaggagaatttgcgacttacttaattggccaccatatctccagtatgaaaagtcagcaaattacattggcagagtatcacattgctaagaaatgaaaggcaacagtttttggaaagggaagcctataggagctctgaaaaaagttaacgctgtagccagaattaatcctagatccagggactgttgaagcaaaaggggaccttaaagagcacccaatatagtatttcctagactatattatttataatatgggtcctatgtgatatcagtaagtgttatgggaaaataatcctgataccaaaaatgtttgagaaaacacttaggtgaacaaaggtagtctggtttctttactacagaaccctgaatatgccaatgtgtattttatatctccaataggacaaatagtgtgcacagcttcccctaaaattgtgactgcagatctgcttttccattgagcatcctatgggtccagtggaacatgtctagggaaagacttagtccaatctcctcattttacaaatgatggaactgagaccaagagaactggcttttcaaaggttgtatgcctgggccaaagtcagcttaagatctctttctcctagtctagcaagactagatgatgaatggcaacaggtcagttatatattctcctggaaagaaaagtatgggttttggccaggtgcagtagctcatgcctgtaatcctagcactttgggaggccaaggcgggtggatcatgaggtcaggagtttgagaccagcctgaccaacatggtgaatccccgtctctactaaaaatacaaaaattagccaggtgtggtggtgcgcacctgtaatcccagctactcaggaggttgaggcagaattgcttgaacctgggaggtggaggttgcagtgagctgagaccatgccactgcactccagcctgggtgac

SEQ ID NO: 2891 - DNA, 558 bp, Homo sapiens
  ENST00000636390
tccaagtccactcagattggagaacatacggatccagcaagaacaaaaaagaggacgttttcacggagggaaatcaagtggaaattcttcttcaagtcttggagaaatggtatctgggacattccgagcaactcccacatcaacagacggagcacattcctccttacgatgttgtaccgtcaatgcgtccggtggtgttagtggggccgtcactgaaaggttacgaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggca

SEQ ID NO: 2892 - DNA, 4589 bp, Homo sapiens
  ENST00000636834
ggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacaggtgagggttgtagttaaactctttttcatacactgtattccttttaaaaatatttgaacacacatgcaagtagttttgctaatttggaaacaatttgaaggcttaatttaaagattctctaattaatatttcatttctcatttgttttctatggtaatttgatttcatttaaaatggtattaaaaattcatgtcattagaatataattttgaaaaatcttatttacccctcagtgttaataactgtccattgtgtaaattgatattcaaaaaattcattattttacctaaggaacggacagagtttaagatggtgaaggccaataaaaaaaggaaaaaaatgatgcagactctcaagaaaatgctgttttcagtctccatgtggaatttcaggatgtattagtacagcccgagctggaagggttgaagcagagagtaaggcagggcccaaaggagggagggcctcgtttacatttggacagcagacagccaagccctggaattaatggtaatgaagagatattggtggcctaatagggaattgtggtacatttggaaacgatggagttattcatgtaggaatttttcttctaccacattccctgattcctatcggctaatttcattctggcctagaactgctgttgcattagggcatccagtgtcctagttaccaattccaattgtattaccaatttggaatggcaagtccaaggccctattctggcctaccaaaactggaggcaactggattggttctggagtggttctaagtgtctgggtccttgttcatgtgaagccctcttatctacaggacactgaaccaaaccaggtttctgagttgtacccaactagactggagctgcttggatgtccacagaatcgctttaaatcagttattgagtatattttgcttcgttcccatttgttggacattcaggacattgaacactttagctattacaaacaggaaagaacaggaataactcattataaatttatctgaggaataactggttataaatgtatttgaaatttagaagcaagatagtaggaaaaatgtgccaatattctagaaaatgggcaaaaatgcccaagggactgcagaattatgagttaacaaatataaaaataactattgattgaggtgatagtcatttttgcccaagtggttattctgtttccttttatgaaattgcatttgtctaccttgttcccagcaacactgtgctgtgtccagcacgggaacaacccatggtgattggctggcccggaacttccagtgttgctctcaactcctgtacccaattcccacccagtgagaaatcaggatataaggtcatttgtaccagggaggaagctgtctgtttttcatacatcttcaaaattgacgtgtccagaatgaaatcataaggcaggttctccaaagtgggcgataggaaggtggtgaagataattacagggacaaatgggtacattcttccatcttttaaactcatgtactgtcatttgcagagtttacatattttgatatggctctcgttattgtcttttagcaaaacagaagcaaaaagtggtaagttgtgtttcctttttaaatctactgttaaggttcctatatatacatgcctgcaatgctccatttcagtgacccaagtggctataaaataagggaagagcctcctcggtggggactttgataatcatttgtcgttcaacctgagaattatgaaattatgaatgttgtggctgtggagaggcatgctcaacctcaccttgtcacgcgtgtcgaatcatctttttcagacggagcacattcctccttacgatgttgtaccgtcaatgcgtccggtggtgttagtggggccgtcactgaaaggttacgaggtacaaatatcatctgttactcttcagttcttgatcgagcacccaggagacagtcatgttgacgcttgctcctcaagggtctgtttccacgtgggtcctgatggaagccagtgctcagcatgggaaggcagggggtaccgtgtggggctcatgaggccctctgccctttctttcctctcttgcacacttctcatcttttatgtattacattgtttagaaatacctccctcaaaatattcacaatgggaagatctggtcaaagatttgctgtacattaaatgcaaagaaaaggactttatctgtcttgaccattctcattattattagaagtaatagagaatgaacagcacaagaggacaaacaatcaatcttccagcaaacccaaacctttaaagcccaaacagagttcaccctgctgggtttttaagatgatggcatatgccaccaaatccttctctgcttatttattttaaagggcacatgttttaaaagaccactaaaaacattagtgaactttggagattaaacaaaaccatgtgacaaggaaaagagtagagacttcgtttcagatgtttgttttgactttgtgctagcttggattaaaaaataggtagaacgtgacattaaactctgaaggtgagcagcctccagggcaccattcccatcgagctaggacaatgtgtggcacatagtaggcactcagtacacatttgctgaatgaattaatgaatcgctttcaggcagatctaagaatcctggctctatccccctctctttctctcttgtctttctcagagttggaaatgtcagagggatgagcaggagagtggtctacaaaaatccagccatgggcatggagaatttccgccaacatacacaaactagcaggaaggctgagtccagtgctggcctcagttctctagctgctcctcactggaggcaggcacaactcaggcgtgccaaggatacccggcacctgtgtacaaagccagcctgttgtctcctggcagcagttctatcccctaacgagggaagagggaagagggaagagggtctggtgaacactgctggtttattcctcaacaccctggaggagaaccaaggggggtggaaattagcaattgcacatggttaagcatgaaaaacaccttccatggtaacctccccctaggagacgaatggctacaataaggtcttggctcatagtacccttccctccctcctctctcccttttgacttctctctctctctctgcatgtgtttgcctcattctttttttctcacctctgcaaaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggtaattagctcctttctgccttaaggtttagaagtgcatcttttaaaaatgtgttttgctctgtggttttttgttagtggacaaaggagaacgtcttgctgattattaataagcacatttaaaatctttccacagtgtacagattctatgaattttcagatagtgaagaatataatagttcatttcttctaaaagctactattgtagatcccaaacaagacagttatgcaagtgtataatagaaacaaaacattaagacagatgtggaaaagtagactctggcttatcatagactatgaattctatattggtaaatttcttggatcctgttgattcctgtgtcatccatactctgtacctagttgagagagt

SEQ ID NO: 2893 - DNA, 5209 bp, Homo sapiens
  ENST00000637622
gtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttaggtaagatgttcaaatgtggtacttcttcaagctgtgcttacagaccgggctgacacatggtgcatttgtgaatgtctttttcaatttgttccccattctgaacgggggagcactgagtacctaaaaagaatgctagctatggacaagaaggcagcagagtcttgcagtagcgagagcttgctgtctctcagctttagtcaattagctaattagtagtctggtggaaagaatcctcaatgggctctcctagtcttttcctgcctaactacatgaaaccagtcatctccactttgctcagcttctcaacaaggctaatgatatctgtcatacctgagtcacagctgacataaaaggaaacgaggtgttcagccttctgagatctttagaagaaaagctagataacggtgttcttggtgttgtgaatggcaatgaccattagtaacatgcagggactttaaacatgtctttcctggggtaccagttggaaagcatcctaaaattccccatgatggagaagaataaaggctgtaagtgagtagctccgtcaagccataggtgagcagggctgtggaggatggatcataacccacagaagcgagtccatagtgctggtgaattacatcgttcatctggaaagcctgttcatggtctccacgattgccaagggtggtgtagtccactcatgacttcctaggattctctttacattcatattctgagggcaacttgttttaactaggaaggataaatagggctcttccatgccttacattttttaaactgttgaaattagctctatagataatagaaaaataaaattaagatttccaagacagagtgcatgccctaacatcacattaagaacccactgaccttgagccaaagatcgtgcaatttgtaaagaaggtacaaaatattatctgtgtgttcctgacatgggattggcatgtgataattgctaataaatgtgggatggttgctttgtgaaggattactaaacataccaaatagagtagtggtcagtgcttgtgaggggaagatcccagcgattagtggtcccttcttttgtcttgtatttagagccttccacatgcagagggaaacatgctcaaaggcacagtattttgaccttgaagaggtacaatggcagtgttgatggtgaatcctattaggtaatgactaaagttaaatatcatgggtgacagggacattaagttaggttgaagtttctcaaacaaacatcaattctctgctctcctgttttctacccattttgtaactccttatagtgtctttggcttttaagtactccttctaatgtatggtgagaggctaaaagataattaaaagcttaagccaggttgtctgactcctttaaccattgacacctgccaagggcttcatgtgtattcactgaagtcattccttacaatccattcacctgctgtcagagtcagtggggtggatggggggcatgttagtgtaaacaagaagaaacaaagtatatctcacctcatggtttttacctttactctgtaaagtcataaacccacaaccattggaattaatttcatggcaatctattaattttataataaccacaatgtgatccatttgtgtgcttgttaatgcacatttgtagattccttcatcaaatgtttattgaacacttgttatgtgccatgcattgtgctagacttaggaaataaagacataacccacacacagtatcttacccatgggcaaagagacagaagagacagatggttagaatacctgtgacagtggaattatgaacaaggaactaggggtataaagaagagtaggggttaagagatgtgtgagaagacttctcagaagttatatttgagctggttcttcaaggcaggcaggaatgtacaaagacattgacatgtaaacaaaaatatgttgttgagaaacaagtagatttgtgtatagcatgcttagaacagggaagttggtggtgtgatttgagaggaacagaagagattgaaaaagattgaggccaatgtgttggggttctaatgcaccttgctaaagagaactccaaaatagatcccatgcaatgttaattttacaacatagtaacagttgttacattcagaatgttttccattgtcaaataaatttggaaatgatgaattaaactgacaggtttcttctctgcaagacttagagccttgaagatatgaaggataatgcatgtttgaaattctaaagagaagctattatagtattcaatataacccttacacaaaacccccttcttcccataggatatcttatgagattattgttccagagtactcactttgggaaatgttgctttggaccctggggagccattgaagtgttttaagcatgggagaaatatgaacaggtttgagtataagggatataatttgtgacagggatcctggagagaggtgggcccaaatcatcatggtcagtttatagaagtgttcatcgaggtcctccagcatcatagtccatgactccccagggctccatttgactggaataggattatgaggaaaacttatttggaacccctctgagaatcagtccaggtagccaagattttttgatttggttgagatctttttctttaaaaaacaaaaaaagagctatatagataaatatgcctcacagataaaatatatttattacattctgtatacatattatccaaacattgggctcaccccagtatttaatgtggccttctccagcatccctgctggcttgttctgcccaagcacctctcttcctctgcccaagtgcctgttgcctaagagttttgtgttggttaagcagtaggtatggctgcccttgctcctggcagaaaccacacttaacctcattgctggtgcagagtaaataaggcccaggtatttctgagtcatttacacagaaactcagagtgccttgagggttatttgtaccagggcagtccagttcacatcaatgtctttctgctgcttctgaaaatattgtattcatatttgaagcttaagaaaacataggcttgctcacatgtagtcctggccaggagctcccataagccagtgacagtttaatgaaaacagcaaatgggaaacataccctgacatcctgaggctgaaatttactacagtaaaaattgactttattttccaaacttccttctgaagaaaatttattttaaaactgtttctgccatgtgagagaaaaggggacaaatatgctacattactaacaaatgtagaatatgatttcagaagaatttgacaaataagcccacttgttttcattaatattctgaaagctagtcacctttccaagcaatgtgaagtctttcaggccattggtattggataacatgaaaagtgatatgttgactcttcaaattaatcctttttaatacagatcatgccttaaacttcagtgattctatgggaaataagaattttatgcaatcatgcaaaacataagaaaatagattttcatgatagtcttgagtattcatgaccctgcacaccttgtcaatccttttggttaaggaagggagaattttttggtgggctatgtgaacttgaatttatactaaataagcaaagcaaatcacaaacacttttcaatgaggatatttagagcaacattacctttttccctaggccatctttagggtcgtttaaggccgggtacaatggctcacacctgtgatgccaacacttcaggaggccaaggcaggaggattgcttggactttggagttcaagaccaacctgggaaacttagtgagacccagtctctacaaaaaataaaaaatttagccaggcacagtgatgtgcacctgtagtcccagctactcggcaagctgaggtgggaggatcacttgagcccagaaggttgaggctgcagtgagctgtgattgtaccactgcactccagcatgggacacagagtgagaccctgtctctaaaaattaataataataatttaagttagatagttttgtgtactgtatgtactttggaccagattacagcattgtttggtcac

SEQ ID NO: 2894 - DNA, 5575 bp, Homo sapiens
  ENST00000636947
gctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtacaaatatcatctgttactcttcagttcttgatcgagcacccaggagacagtcatgttgacgcttgctcctcaagggtctgtttccacgtgggtcctgatggaagccagtgctcagcatgggaaggcagggggtaccgtgtggggctcatgaggccctctgccctttctttcctctcttgcacacttctcatcttttatgtattacattgtttagaaatacctccctcaaaatattcacaatgggaagatctggtcaaagatttgctgtacattaaatgcaaagaaaaggactttatctgtcttgaccattctcattattattagaagtaatagagaatgaacagcacaagaggacaaacaatcaatcttccagcaaacccaaacctttaaagcccaaacagagttcaccctgctgggtttttaagatgatggcatatgccaccaaatccttctctgcttatttattttaaagggcacatgttttaaaagaccactaaaaacattagtgaactttggagattaaacaaaaccatgtgacaaggaaaagagtagagacttcgtttcagatgtttgttttgactttgtgctagcttggattaaaaaataggtagaacgtgacattaaactctgaaggtgagcagcctccagggcaccattcccatcgagctaggacaatgtgtggcacatagtaggcactcagtacacatttgctgaatgaattaatgaatcgctttcaggcagatctaagaatcctggctctatccccctctctttctctcttgtctttctcagagttggaaatgtcagagggatgagcaggagagtggtctacaaaaatccagccatgggcatggagaatttccgccaacatacacaaactagcaggaaggctgagtccagtgctggcctcagttctctagctgctcctcactggaggcaggcacaactcaggcgtgccaaggatacccggcacctgtgtacaaagccagcctgttgtctcctggcagcagttctatcccctaacgagggaagagggaagagggaagagggtctggtgaacactgctggtttattcctcaacaccctggaggagaaccaaggggggtggaaattagcaattgcacatggttaagcatgaaaaacaccttccatggtaacctccccctaggagacgaatggctacaataaggtcttggctcatagtacccttccctccctcctctctcccttttgacttctctctctctctctgcatgtgtttgcctcattctttttttctcacctctgcaaaggtaacagacatgatgcagaaagccctctttgatttcctgaagcacaggtttgatgggaggtgagaaatatagatgtttttgtatttttattttcctttaaccaaacttgtgtgataaattgaattgtagatctatgtttccagagatttcagaagttctctagttaaaagttaactcagtattcttgggaagaatataataaaagaactctgaaaatatgaagtataacattgagtccccagtgaagaaaggaccatgagaagaaaaataagccatttgttttatttaaatgtatatatctttattttctcagttattaataatttcataccaaaatgttttttatgaaaaaatattaattaaaatatataatatttctcatgagtatagtggcttgctggtcaaactaggcagtatttgggaattgtgtatgtgtgtgtgtgtgtgtgtgtgtgtgtgtgtgtcatatgaaagcataaatgtcaagtactgaatttcctcaaaagaagagagtgagaattattttaatcataagcctcccaaagtgatcattttgtagggaatagtacttatttggatatttattatagttgtgggttgtttttattagaaatgtccttgttattttattgatctttttttaatgtattttactatgatccatcaacaatatggctcaggcattagccattaaataattttatcatttaagttttgtgaaaaattctaaagaaagtttctctgttttgcagagaaatggtaaaaagcctgtattgactcaattctaaatattaagctctttcacagtgctgaatgcagtccatgtaaaaataaccacatgaaaaaacctgagatttatcagaaatgtaggaaatttaaatggggtgcatcaaaaagtatgggcaaatgcatccagtttattactgtaggattgaagaaaaacatcacattctttatttttgaaggcagtaattaagccattcactttctctttgctaaattatgagaatccactaaatgcacaaaataattttaaaatgtaaaaaaacttcagatagattttaataaattggtatattaagaataaaaacaagcatggtattgctttaaatataaattgtatgcatttgttaaaataaaagctttctggataattgggtaaaatattcattagtttctggaacaatatagaaagttagtaaacagattttagtttaagaaataagaatgcttctaggtacattagtatataggtcaggctgccttaataaatagaccccaaaatgtgtagtgattcaaacacaatggaagcttattattgctcacttaacagtctgaagcaggtgttccttggctgggagggaggatagagttgggggaggggagaattgggcagaaagtttgttccctctgtcatttggggcccttagcccaggtacgatgtctctagtcagcttgcccggcctggaggtagcgcaactgacatttcactggttagaacttggttatgtggtcatacttaattgcagcggaggcactcttgcagtccaggaggaagaggagatagaatttgttgaatcaataatagccttcgtcacattcatctactggacaaaggcttaataagaaagatgtatttgttccatttcactctctttaaaaaagaaataggcagataatgaagtagcttcaaagaaaataagttaaaagccctgaatcctagagcattggagttggaaggatacataaaatgtcttttagactcatcatttctccaataaccacaatcagatagacaacctgcttctgtttgaaacttttggttattgggattacactttctaaaaaagcattgcaaaaaaatagctgaactctgactttgtaacttaatagggctggtcttggtcttgctgtctgatgctctggccttaaccctaaccctcatgcaggtccctgtggattgaaggcagccagcatgccttggtcgcacgtgcatagttccttcagatatgtatggagtcacatggtttcaacctgtggagctgttacctaaggcagttctgagcagtgccgaatccactggccccataacagccctatctgaacaaatcccatcccataagacagtgttagattattttggtctataacatacttatacgcaacagtgctgttaaaggtttgccctcaagaatgaagaatctgatgttcttcctcaatcctgaggcccagaaaaagggaatttatttaattgtaacagcagagatttgtctcgaatcaagtagaattgtcgcatccattactgtacacatactactgaagttggttttaatagaaattgaatgcaaatttcaatctcaagtattcatggggtctgatgacatggcagagggtctggaggaagagcccagcagtagcaaaagtaatagctgaagagagagacttagccctggagaaatctgatatatttctccagcaggagaaagataggtagatattaaaggggtgaggggtgagagaatggacttgatttcaaatattaagaggccaggcagcagaatgaacaataaggagttccttggttgagtgtatgtggagactttgataagaaagaaattcgctggtagcgtcacactgactctgacatgtcttcttcgtggggaatatcgttaggttttgagctataacatcatgctgcattatgttttaccaattgatacaaggagagaaaaaaacaaatagtctttaattgaaaccagccaagagaacaatgacaaggaaggctttagcacagtgacacggcataaacaatatgttctaatggaaacctactctgtgtttcatgggctatgaatgcagtacgttagacaaaataggagaaagtcctattatttttcagaaagtacaaagaagggatctgttggctacgaggctttcttctttaatctgcttttcagatcttagtagaaaataattcaacaaattggatgaaagtccaacagtttgactattgcagaatcataaacttgggatttttttgataccttagaaattatttgagtcagtttagagctacttattatacaattttattgctgtagctgctattgtggggcctaactgtaatacatgtaagaaaaacagaatactaggctgggcgcagtggctcatgcctataatcccagcactttgggaggcccaggtgggcagatcacctgaggtcgggagttcgagaccagcctgaccaacatggagaaacctcatctctaataaaaatacaaaattagccaggcgtggtggcgcgtgcctgtaattccagccactcgggaggctgaggcaggaaaatcacttgaacctgggaggcagaggttgcggtgagccaagatcatgccattgcactccagcctgggcaataggagcaaaactctgtctcaataaaaaaaaaaaaa

SEQ ID NO: 2895 - DNA, 8233 bp, Homo sapiens
  ENST00000637884
tgtcatggttctgtagactgtaaaggaagcatggcagcatctgcttctggggaggtctcagggagattttactggtagcagaaggccaagcgggagcaggtgtcttacatgcctggagcaggaggaagagacggggaggtgccacacacttttaaacaatcagatctcactataactcactcattgtcacaggaacagcacaaggagatggtgccaaaccattcatgagggactgcccccgtggtccagtcacctctcaccagtccccacctccatcactggggattacatctcaacatgagatttgcgggggacacagatccaaaccatattatccctttttttctaaaattttgtcttccatgcccctttttagacacatggggagcatgtgttcctgtcttggggtctttgcatttgctgttttttcttactggaacctttttcttcacacttacacccggccactccatctgctttatatctttgttaggtatcaccctttcagtgacccctttcctgccaattgtatttaaaattgtacccactccccttccctgtacttcccatcccttccctgacttagttttctctgttgcacttattactctcagaaatattatatatttacctatctatcttgtttggtataagctgagcatccataatctgaaaagctgaaatccagaatgttccaaaatttgaaactttttgaggactgacatgatgctcaaaggagatgctcattagagcattttcgatttcagacatttggattagggatgttcaactaagtatatagtgcaaatttccgaaatctgaaaacagtggaaatccaaaacatttctgctcccaggcattttggataagggatattcaacctgtactgatatgtcctactagtatatgactcaataagggaaaggattttgtctccccaatgccgctgtcttatttctactttccaaaacagggatgtacaatccatatttgttgaataaaataactgaattattatcattttcaaagttttattgttattattatttcttaattgttacagtcatgggccatataacttttttgtcaaagacaaaaagtaggaaggtggcagctcccgacggcatttgtgggcttcagggaagcttccagagcacacctgaggagaccagagttgaggatcttctatttaaataaataatatttttcgtgaccaattccctacgatcagttcttaattctgatgcccacataatcatcttgtaagaagaaatggtttctccaggtctaactgcttgttttgagctgtgtttgacatctgactggcacattggtgcctggtgttaggttaacaagcagttcataagaccattcccgtcagtgatggttttgtctgatttccgcactgagtaactagaagagatgcttttgcagagtattccaggtctcggctagttctccacattctcttagaaatgaggtcaaagaaaacatttggatagattcttgaaattctttatagcagaatttggtgtgttttgaattatttaataggatgagggccaaagaaagctttgtactctcaagttctattttcaaagaatctggggagtgagtctttagttccttttctatatcctaggaaatcaagtggaaattcttcttcaagtcttggagaaatggtatctgggacattccgagcaactcccacatcaacaggtgagggttgtagttaaactctttttcatacactgtattccttttaaaaatatttgaacacacatgcaagtagttttgctaatttggaaacaatttgaaggcttaatttaaagattctctaattaatatttcatttctcatttgttttctatggtaatttgatttcatttaaaatggtattaaaaattcatgtcattagaatataattttgaaaaatcttatttacccctcagtgttaataactgtccattgtgtaaattgatattcaaaaaattcattattttacctaaggaacggacagagtttaagatggtgaaggccaataaaaaaaggaaaaaaatgatgcagactctcaagaaaatgctgttttcagtctccatgtggaatttcaggatgtattagtacagcccgagctggaagggttgaagcagagagtaaggcagggcccaaaggagggagggcctcgtttacatttggacagcagacagccaagccctggaattaatggtaatgaagagatattggtggcctaatagggaattgtggtacatttggaaacgatggagttattcatgtaggaatttttcttctaccacattccctgattcctatcggctaatttcattctggcctagaactgctgttgcattagggcatccagtgtcctagttaccaattccaattgtattaccaatttggaatggcaagtccaaggccctattctggcctaccaaaactggaggcaactggattggttctggagtggttctaagtgtctgggtccttgttcatgtgaagccctcttatctacaggacactgaaccaaaccaggtttctgagttgtacccaactagactggagctgcttggatgtccacagaatcgctttaaatcagttattgagtatattttgcttcgttcccatttgttggacattcaggacattgaacactttagctattacaaacaggaaagaacaggaataactcattataaatttatctgaggaataactggttataaatgtatttgaaatttagaagcaagatagtaggaaaaatgtgccaatattctagaaaatgggcaaaaatgcccaagggactgcagaattatgagttaacaaatataaaaataactattgattgaggtgatagtcatttttgcccaagtggttattctgtttccttttatgaaattgcatttgtctaccttgttcccagcaacactgtgctgtgtccagcacgggaacaacccatggtgattggctggcccggaacttccagtgttgctctcaactcctgtacccaattcccacccagtgagaaatcaggatataaggtcatttgtaccagggaggaagctgtctgtttttcatacatcttcaaaattgacgtgtccagaatgaaatcataaggcaggttctccaaagtgggcgataggaaggtggtgaagataattacagggacaaatgggtacattcttccatcttttaaactcatgtactgtcatttgcagagtttacatattttgatatggctctcgttattgtcttttagcaaaacagaagcaaaaagtggtaagttgtgtttcctttttaaatctactgttaaggttcctatatatacatgcctgcaatgctccatttcagtgacccaagtggctataaaataagggaagagcctcctcggtggggactttgataatcatttgtcgttcaacctgagaattatgaaattatgaatgttgtggctgtggagaggcatgctcaacctcaccttgtcacgcgtgtcgaatcatctttttcagacggagcacattcctccttacgatgttgtaccgtcaatgcgtccggtggtgttagtggggccgtcactgaaaggttacgaggtacaaatatcatctgttactcttcagttcttgatcgagcacccaggagacagtcatgttgacgcttgctcctcaagggtctgtttccacgtgggtcctgatggaagccagtgctcagcatgggaaggcagggggtaccgtgtggggctcatgaggccctctgccctttctttcctctcttgcacacttctcatcttttatgtattacattgtttagaaatacctccctcaaaatattcacaatgggaagatctggtcaaagatttgctgtacattaaatgcaaagaaaaggactttatctgtcttgaccattctcattattattagaagtaatagagaatgaacagcacaagaggacaaacaatcaatcttccagcaaacccaaacctttaaagcccaaacagagttcaccctgctgggtttttaagatgatggcatatgccaccaaatccttctctgcttatttattttaaagggcacatgttttaaaagaccactaaaaacattagtgaactttggagattaaacaaaaccatgtgacaaggaaaagagtagagacttcgtttcagatgtttgttttgactttgtgctagcttggattaaaaaataggtagaacgtgacattaaactctgaaggtgagcagcctccagggcaccattcccatcgagctaggacaatgtgtggcacatagtaggcactcagtacacatttgctgaatgaattaatgaatcgctttcaggcagatctaagaatcctggctctatccccctctctttctctcttgtctttctcagagttggaaatgtcagagggatgagcaggagagtggtctacaaaaatccagccatgggcatggagaatttccgccaacatacacaaactagcaggaaggctgagtccagtgctggcctcagttctctagctgctcctcactggaggcaggcacaactcaggcgtgccaaggatacccggcacctgtgtacaaagccagcctgttgtctcctggcagcagttctatcccctaacgagggaagagggaagagggaagagggtctggtgaacactgctggtttattcctcaacaccctggaggagaaccaaggggggtggaaattagcaattgcacatggttaagcatgaaaaacaccttccatggtaacctccccctaggagacgaatggctacaataaggtcttggctcatagtacccttccctccctcctctctcccttttgacttctctctctctctctgcatgtgtttgcctcattctttttttctcacctctgcaaaggtaacagacatgatgcagaaagccctctttgatttcctgaagcacaggtttgatgggaggtgagaaatatagatgtttttgtatttttattttcctttaaccaaacttgtgtgataaattgaattgtagatctatgtttccagagatttcagaagttctctagttaaaagttaactcagtattcttgggaagaatataataaaagaactctgaaaatatgaagtataacattgagtccccagtgaagaaaggaccatgagaagaaaaataagccatttgttttatttaaatgtatatatctttattttctcagttattaataatttcataccaaaatgttttttatgaaaaaatattaattaaaatatataatatttctcatgagtatagtggcttgctggtcaaactaggcagtatttgggaattgtgtatgtgtgtgtgtgtgtgtgtgtgtgtgtgtgtgtcatatgaaagcataaatgtcaagtactgaatttcctcaaaagaagagagtgagaattattttaatcataagcctcccaaagtgatcattttgtagggaatagtacttatttggatatttattatagttgtgggttgtttttattagaaatgtccttgttattttattgatctttttttaatgtattttactatgatccatcaacaatatggctcaggcattagccattaaataattttatcatttaagttttgtgaaaaattctaaagaaagtttctctgttttgcagagaaatggtaaaaagcctgtattgactcaattctaaatattaagctctttcacagtgctgaatgcagtccatgtaaaaataaccacatgaaaaaacctgagatttatcagaaatgtaggaaatttaaatggggtgcatcaaaaagtatgggcaaatgcatccagtttattactgtaggattgaagaaaaacatcacattctttatttttgaaggcagtaattaagccattcactttctctttgctaaattatgagaatccactaaatgcacaaaataattttaaaatgtaaaaaaacttcagatagattttaataaattggtatattaagaataaaaacaagcatggtattgctttaaatataaattgtatgcatttgttaaaataaaagctttctggataattgggtaaaatattcattagtttctggaacaatatagaaagttagtaaacagattttagtttaagaaataagaatgcttctaggtacattagtatataggtcaggctgccttaataaatagaccccaaaatgtgtagtgattcaaacacaatggaagcttattattgctcacttaacagtctgaagcaggtgttccttggctgggagggaggatagagttgggggaggggagaattgggcagaaagtttgttccctctgtcatttggggcccttagcccaggtacgatgtctctagtcagcttgcccggcctggaggtagcgcaactgacatttcactggttagaacttggttatgtggtcatacttaattgcagcggaggcactcttgcagtccaggaggaagaggagatagaatttgttgaatcaataatagccttcgtcacattcatctactggacaaaggcttaataagaaagatgtatttgttccatttcactctctttaaaaaagaaataggcagataatgaagtagcttcaaagaaaataagttaaaagccctgaatcctagagcattggagttggaaggatacataaaatgtcttttagactcatcatttctccaataaccacaatcagatagacaacctgcttctgtttgaaacttttggttattgggattacactttctaaaaaagcattgcaaaaaaatagctgaactctgactttgtaacttaatagggctggtcttggtcttgctgtctgatgctctggccttaaccctaaccctcatgcaggtccctgtggattgaaggcagccagcatgccttggtcgcacgtgcatagttccttcagatatgtatggagtcacatggtttcaacctgtggagctgttacctaaggcagttctgagcagtgccgaatccactggccccataacagccctatctgaacaaatcccatcccataagacagtgttagattattttggtctataacatacttatacgcaacagtgctgttaaaggtttgccctcaagaatgaagaatctgatgttcttcctcaatcctgaggcccagaaaaagggaatttatttaattgtaacagcagagatttgtctcgaatcaagtagaattgtcgcatccattactgtacacatactactgaagttggttttaatagaaattgaatgcaaatttcaatctcaagtattcatggggtctgatgacatggcagagggtctggaggaagagcccagcagtagcaaaagtaatagctgaagagagagacttagccctggagaaatctgatatatttctccagcaggagaaagataggtagatattaaaggggtgaggggtgagagaatggacttgatttcaaatattaagaggccaggcagcagaatgaacaataaggagttccttggttgagtgtatgtggagactttgataagaaagaaattcgctggtagcgtcacactgactctgacatgtcttcttcgtggggaatatcgttaggttttgagctataacatcatgctgcattatgttttaccaattgatacaaggagagaaaaaaacaaatagtctttaattgaaaccagccaagagaacaatgacaaggaaggctttagcacagtgacacggcataaacaatatgttctaatggaaacctactctgtgtttcatgggctatgaatgcagtacgttagacaaaataggagaaagtcctattatttttcagaaagtacaaagaagggatctgttggctacgaggctttcttctttaatctgcttttcagatcttagtagaaaataattcaacaaattggatgaaagtccaacagtttgactattgcagaatcataaacttgggatttttttgataccttagaaattatttgagtcagtttagagctacttattatacaattttattgctgtagctgctattgtggggcctaactgtaatacatgtaagaaaaacagaatactaggctgggcgcagtggctcatgcctataatcccagcactttgggaggcccaggtgggcagatcacctgaggtcgggagttcgagaccagcctgaccaacatggagaaacctcatctctaataaaaatacaaaattagccaggcgtggtggcgcgtgcctgtaattccagccactcgggaggct

SEQ ID NO: 2896 - DNA, 4036 bp, Homo sapiens
  ENST00000470066
gggcgccggcgcgggtcctggagccgggtggggaagtcctgcgccctccccctccgtccgcagcccagcctcgggggccagccccctccgcccaccgcacacgggctggccatgcggcggctctgaacgatgtcctcctcctcctacgccaagaacgggaccgcggacgggccgcactcccccacctcgcaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggtgagaaatatagatgtttttgtatttttattttcctttaaccaaacttgtgtgataaattgaattgtagatctatgtttccagagatttcagaagttctctagttaaaagttaactcagtattcttgggaagaatataataaaagaactctgaaaatatgaagtataacattgagtccccagtgaagaaaggaccatgagaagaaaaataagccatttgttttatttaaatgtatatatctttattttctcagttattaataatttcataccaaaatgttttttatgaaaaaatattaattaaaatatataatatttctcatgagtatagtggcttgctggtcaaactaggcagtatttgggaattgtgtatgtgtgtgtgtgtgtgtgtgtgtgtgtgtgtgtcatatgaaagcataaatgtcaagtactgaatttcctcaaaagaagagagtgagaattattttaatcataagcctcccaaagtgatcattttgtagggaatagtacttatttggatatttattatagttgtgggttgtttttattagaaatgtccttgttattttattgatctttttttaatgtattttactatgatccatcaacaatatggctcaggcattagccattaaataattttatcatttaagttttgtgaaaaattctaaagaaagtttctctgttttgcagagaaatggtaaaaagcctgtattgactcaattctaaatattaagctctttcacagtgctgaatgcagtccatgtaaaaataaccacatgaaaaaacctgagatttatcagaaatgtaggaaatttaaatggggtgcatcaaaaagtatgggcaaatgcatccagtttattactgtaggattgaagaaaaacatcacattctttatttttgaaggcagtaattaagccattcactttctctttgctaaattatgagaatccactaaatgcacaaaataattttaaaatgtaaaaaaacttcagatagattttaataaattggtatattaagaataaaaacaagcatggtattgctttaaatataaattgtatgcatttgttaaaataaaagctttctggataattgggtaaaatattcattagtttctggaacaatatagaaagttagtaaacagattttagtttaagaaataagaatgcttctaggtacattagtatataggtcaggctgccttaataaatagaccccaaaatgtgtagtgattcaaacacaatggaagcttattattgctcacttaacagtctgaagcaggtgttccttggctgggagggaggatagagttgggggaggggagaattgggcagaaagtttgttccctctgtcatttggggcccttagcccaggtacgatgtctctagtcagcttgcccggcctggaggtagcgcaactgacatttcactggttagaacttggttatgtggtcatacttaattgcagcggaggcactcttgcagtccaggaggaagaggagatagaatttgttgaatcaataatagccttcgtcacattcatctactggacaaaggcttaataagaaagatgtatttgttccatttcactctctttaaaaaagaaataggcagataatgaagtagcttcaaagaaaataagttaaaagccctgaatcctagagcattggagttggaaggatacataaaatgtcttttagactcatcatttctccaataaccacaatcagatagacaacctgcttctgtttgaaacttttggttattgggattacactttctaaaaaagcattgcaaaaaaatagctgaactctgactttgtaacttaatagggctggtcttggtcttgctgtctgatgctctggccttaaccctaaccctcatgcaggtccctgtggattgaaggcagccagcatgccttggtcgcacgtgcatagttccttcagatatgtatggagtcacatggtttcaacctgtggagctgttacctaaggcagttctgagcagtgccgaatccactggccccataacagccctatctgaacaaatcccatcccataagacagtgttagattattttggtctataacatacttatacgcaacagtgctgttaaaggtttgccctcaagaatgaagaatctgatgttcttcctcaatcctgaggcccagaaaaagggaatttatttaattgtaacagcagagatttgtctcgaatcaagtagaattgtcgcatccattactgtacacatactactgaagttggttttaatagaaattgaatgcaaatttcaatctcaagtattcatggggtctgatgacatggcagagggtctggaggaagagcccagcagtagcaaaagtaatagctgaagagagagacttagccctggagaaatctgatatatttctccagcaggagaaagataggtagatattaaaggggtgaggggtgagagaatggacttgatttcaaatattaagaggccaggcagcagaatgaacaataaggagttccttggttgagtgtatgtggagactttgataagaaagaaattcgctggtagcgtcacactgactctgacatgtcttcttcgtggggaatatcgttaggttttgagctataacatcatgctgcattatgttttaccaattgatacaaggagagaaaaaaacaaatagtctttaattgaaaccagccaagagaacaatgacaaggaaggctttagcacagtgacacggcataaacaatatgttctaatggaaacctactctgtgtttcatgggctatgaatgcagtacgttagacaaaataggagaaagtcctattatttttcagaaagtacaaagaagggatctgttggctacgaggctttcttctttaatctgcttttcagatcttagtagaaaataattcaacaaattggatgaaagtccaacagtttgactattgcagaatcataaacttgggatttttttgataccttagaaattatttgagtcagtttagagctacttattatacaattttattgctgtagctgctattgtggggcctaactgtaatacatgtaagaaaaacagaatactaggctgggcgcagtggctcatgcctataatcccagcactttgggaggcccaggtgggc

SEQ ID NO: 2897 - DNA, 2283 bp, Homo sapiens
  ENST00000636129
gcaccctgagagtctttgttaatggatgtggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtacaaatatcatctgttactcttcagttcttgatcgagcacccaggagacagtcatgttgacgcttgctcctcaagggtctgtttccacgtgggtcctgatggaagccagtgctcagcatgggaaggcagggggtaccgtgtggggctcatgaggccctctgccctttctttcctctcttgcacacttctcatcttttatgtattacattgtttagaaatacctccctcaaaatattcacaatgggaagatctggtcaaagatttgctgtacattaaatgcaaagaaaaggactttatctgtcttgaccattctcattattattagaagtaatagagaatgaacagcacaagaggacaaacaatcaatcttccagcaaacccaaacctttaaagcccaaacagagttcaccctgctgggtttttaagatgatggcatatgccaccaaatccttctctgcttatttattttaaagggcacatgttttaaaagaccactaaaaacattagtgaactttggagattaaacaaaaccatgtgacaaggaaaagagtagagacttcgtttcagatgtttgttttgactttgtgctagcttggattaaaaaataggtagaacgtgacattaaactctgaaggtgagcagcctccagggcaccattcccatcgagctaggacaatgtgtggcacatagtaggcactcagtacacatttgctgaatgaattaatgaatcgctttcaggcagatctaagaatcctggctctatccccctctctttctctcttgtctttctcagagttggaaatgtcagagggatgagcaggagagtggtctacaaaaatccagccatgggcatggagaatttccgccaacatacacaaactagcaggaaggctgagtccagtgctggcctcagttctctagctgctcctcactggaggcaggcacaactcaggcgtgccaaggatacccggcacctgtgtacaaagccagcctgttgtctcctggcagcagttctatcccctaacgagggaagagggaagagggaagagggtctggtgaacactgctggtttattcctcaacaccctggaggagaaccaaggggggtggaaattagcaattgcacatggttaagcatgaaaaacaccttccatggtaacctccccctaggagacgaatggctacaataaggtcttggctcatagtacccttccctccctcctctctcccttttgacttctctctctctctctgcatgtgtttgcctcattctttttttctcacctctgcaaaggtaacagacatgatgcagaaagccctctttgatttcctgaagcacaggtttgatgggaggtgagaaatatagatgtttttgtatttttattttcctttaaccaaacttgtgtgataaattgaattgtagatctatgtttccagagatttcagaagttctctagttaaaagttaactcagtattcttgggaagaatataataaaagaactctgaaaatatgaagtataacattgagtccccagtgaagaaaggaccatgagaagaaaaataagccatttgttttatttaaatgtatatatctttattttctcagttattaata

SEQ ID NO: 2898 - DNA, 605 bp, Homo sapiens
  ENST00000638056
aagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagacggagcacattcctccttacgatgttgtaccgtcaatgcgtccggtggtgttagtggggccgtcactgaaaggttacgaggtacaaatatcatctgttactcttcagttcttgatcgagcacccaggagacagtcatgttgacgcttgctcctcaagggtctgtttccacgtgggtcctgatggaagccagtgctcagcatgggaaggcagggggtaccgtgtggggctcatgaggccctctgccctttctttcctctcttgcacacttctcatcttttatgtattacattgtttagaaatacctccctcaaaatattcacaatgggaagatctggtcaaagatttgctgtacattaaatgcaaagaaaagga

SEQ ID NO: 2899 - DNA, 720 bp, Homo sapiens
  ENST00000434468
agcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacga

SEQ ID NO: 2900 - DNA, 745 bp, Homo sapiens
  ENST00000635743
actttacagctgaagaaaaagaaatccagcaaaattaaatgatttgcccaaggtcctataaccagtggactgcaaggctggactagagggcagagtttccatcccatgggtgcaggccaggtcctgagggacacgcttctctctgtagagagctgtctctcctgctcacatcctgggtaaatccttattggcaaagaataaggtgggagagaaggtggccaacaaagtgctagctctgccaacttctctcatcgtcaggagacaagtgttgcagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtg

SEQ ID NO: 2901 - DNA, 1807 bp, Homo sapiens
  ENST00000635835
gctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagaggtaaatgtagaacatactgcatcccttcacctgccaaaaagctgaagccaggaatcagctctgagccaaactagccagagaggagacccaaggagctgccagtgcagtacatgatttaatttgctgagcctcccaaatctagtcattctcattaagattgagaagtctgagatcattgcttgcattatcacacactgacaacattaaatcacagtcaaccttaaaattatagcatagatttctgacagacctctatggtcctctgggcacctttaaatccccttctgtgactgcagagccataaatatatggatccaactttggaaaatgtaagtttggtgtcatggcacctacccagaagggactgtttacaggggatgttgtaattatagacatgtagactatagtgctgtgcaccttgactatggaaccaacactagagtgtataatcattcaaagaaagatttacagctaagaaaagggcagagggctctgggaaacagaaaggcaaaagggtaaagtgtttgagtagccaagaagggtgggatccaagacccctagtggagggacagacctttgatagaaagaagaatgctaattcattgtgacatgcagggaaaagatgagtgcaggcacagacacttcagggccttgggaataggaaactgaggacccatcaacttcaaccatggcctctactttcttgatggtatatgaggtgaggatgtctacatttgtctagaagacaagaactcttgacctgaaacatgtgccctggcatctgaatggttaagttgattatgtctcaccatttccatcaaaaatgcccaagccatattcattagttgctaatacccactgtgtccaaggagaagcaccacttgaaaaggtaagagatgttcttacatgtgacatgcacactcactcacaccaacattccaaccttgtatttgattgctttcctgcattgtatcaaggtctcaatttgtcctggctgctgtttgagctatgtgcttgttgatcagtgattttctcttcagtctggcagtttgatgtgacattgagctggtaatcttatgtggaccagagcctcttgttttcatgtcttgaaattatcagataagaaaacatctttgatatagaaagtgctaatcattttagggaaatccaaatagagaagggttggaacaacaccgaggtgacctctgtagagagctggcacaagttcccagaacatcaacacaaatgaatacatttctataatcaagttatagccttccctctc

SEQ ID NO: 2902 - DNA, 1174 bp, Homo sapiens
  ENST00000475848
caccatgcccggctaatttttgtatttttagtagagatggggtttcaccatgtcagccaggctggtctcaaactcctgacctggtgatccacccaccttggcctcccaaagtgctgggattacaggcgtgagccaccgtgcccagccttcagtgctgtttaaatagctcttctagtgtgggcttcaactgagaacatccctgttttcatcctcaaggttgtttttctgctcagtgttcttgttgaccacgtctgggctgctgcaggacaatgattgaagttttagtagtgaaagagttcaatagtgttgacattgaaactggaaaatcattttactaatgtaagatgatgctttactatattgaaatcttagacaaatagatgacccatagcccaaatacaggtaggatttatcttttgtaataagctgagtctctttttcctttagatgtatatgcaaaagagaagatggatgaaaactaacgtttcacaagtgatatgggcttaatatagcacaaaacaagaagaattggtgctgagtatcacataattttcattgcagtttacttcctagcacttaatctagtcaaaatatttttcttcacaacattgctactttccgaataactcagatgcttaactatattctgccatctaaatttatatctgcaataaggcatggagtgtgtgcatcaaattttaggcaaatgaaaaagaactcgccccaggatactgttatggatgtgacaatttaagaagctacacatcatctgaaactattctattttctttgccagggttcagcggattcctacacaagcaggccgtctgactccgatgtctctttggaagaggaccgggaagcaattcgacaggagagagaacagcaagcagctatccagcttgagagagcaaaggtgagtctctttccttctctttggctcaaaagtgggtcgttgctcagtggctaccagctgctcttcccttacctcacatttctggaataatcattttgtgattattctaacaaggctccagattgggaagctctctgatcctttcacctctaagtgaggttagtaacatctccaaagaggcatttcctcagaaccttcacctttttgtatttggtttggtggtgaattattggtcgtcttccaacttagcaatatcaa

SEQ ID NO: 2903 - DNA, 430 bp, Homo sapiens
  ENST00000636496
gcccgcagcctcccccagcggatgccggggactcggaccccgcaccctgagagtctttgttaatggatgtggtggcccgaggcaccacaacccggaggagcaggttgaaaagatccgatggcagcaccacttcgaccagcttcatcctcagacaggaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagag

SEQ ID NO: 2904 - DNA, 6849 bp, Homo sapiens
  ENST00000638083
attgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgtaagtattttcatagatagctaattccctctcccctcctcttcctcctcccactatcccctccacccccccgcttcttatttcttaggcaacgcagggaacatggagcagaaagctaacatcattctggggcttgctggctgctgtgtaaatgttctctgtgtagtttataggtaactaaaattatttattgtcaagcaaaaaagaaattagggtgatggcaaagcattcaagagtgtaggctgtttgaatttatacattaccgggtccacgtttgatctcaccaggggtaactgctccttgcagactggtttaaactatgcagaaagtgcctatgttttccaatagcagggttcatagaaaagcctcattcattatataatacacattgtttgttgagctagcatgaatggaagttcctaagctgtggctgtattattatgtgctttctggccaaacaagcagtgcagatatactgcttctttgttaaggaaatcagatgctaggcttgtggccatacagcaatccagtgcagaggcagtgggcagtgttcctatactctaccttggaagagcgaagcagactcacgtgtgttttgggttagagaactggactccttctcccccctaggtcaggctcatgcaatctgttaaaatcagggtgaaataatttcctgaaatccctgaaatcataccatagagtgctagcttttaaatataaggtaaagctgataattgaatctttcttttgactcttgctggtggtagttcctatttttttcatcaatacacagaaacctcgcaaggtagaatggctgggggtggttaatgggaagtgctgtggggagtctgaattttatgtgagtgcagtgccaatacatgttgctacatttgaaacaggagtgtgttatataagattctctggctaaaccaccaaataaacaggttataacaaaaaaaaaacaaaaaacaaaaaaaaaccctgtggtatacgtcaatgcagacgtatatgtctaatgatgtgctatccatgaaagatagaaatcctcagttctgttaaggcattccatttttccttcctgtctgtgtgttttctctaactctaactctgtttccgcaaagtctctctgcgtgttgcccaacgtgctcataaatgatcagactgtcagtgtattgtaagggactgtagtctgaaacattggtggctgaaatcaagaaggtccacacttgcaggtggggtgggggaatggcaaaggcaattacaggagttcagtaagccagcttcctgggctggtttcttcagaaggcctgatcacttcttctaccccttctctgctcactcagttatgaaacctatgatgccttgtgaattgtaagttttattttcggccattgattttaaacttgggcaggcagtgaattgcaccgaagtggactggagtcattttagaaatgcctgtagaaactggctgctgtgaagagttggctaggaactaataaatccagctccttgttctccagaactgtatacatttcagatgcactggttcagaggggagccattataagtatgaaaacatttttttttttttttttttttgcctttgggtccagtgtcacaggacagctgagtttttctgtaagatgggaagtgaagagtgcagtgacttgactcggtggcagtagttgatggcgggtagtgctaggtactgcagtgctgtactcctggtgactcagtggtggccagcaggctgagatcctccgggctgtgcacatctgtggaggtgaggaaggtgggaaacatgaggagtggagttgggcatctggccaatcctcagttgagagtatgggaggctttcaggtgggcgggattgaaaccgtgtcacataaatcaggggaagagagagatgttcggaggggtgaactgactctgaatgctcatttgagtttatttgtttttataaggaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctgtaagtgtggggggttgtccagatggaagcagagctctcggaacaggtctggtggataggcgtggaaaggcttttctcagatggctagctgcagtccgagaatatataggcactaaaagctgagtacggcacttcggttgggggtgggggttggggaaccatccgcatatgtcctaccgttctgtgctgttgaaaatgtctttgtggggtgtgtgggggttaacttgtgataagtgattattttcaatgttttcacacagtaagcttgtaataagatcatcttgcctagggacaattttattccgaataagagtaaaccattattatacactgttagcacctcacatccccacagtaggagagagatgttggtactgtgatgcaaggctttcttaagagtttggtccaaaagtagatgttatgctcccagtgccctagattttagtttgtaacctccgtgtttcacatactctatatgtgaagagagaggaaaaagaaacatgccgaaacacacttgagtcaggcattttagattctttttttttttttttttgagacggagtctcgctctgtcgcccaggctggacattttagattcttgagtcctgtggagcctttttgggcaagtccattaacttctgctttggtgtccaggagggtagttaagaatctggattacaaggaagtgcaaaagatcattcagtgccccacagcagggccccacttccgaataggagatttcacacagaacgtcaccttacttcttgtattaccttgacatagatgatggagtgtgtgcttccagatgaacccatacctagcccaggctggttccagtggatcatgcacatcgactcttcctacattagctgctatataagagctgcctattctaccttcactgtccccactgtgtgttaatacaagttctagtggccaagatttttttcatggactgagccccccatgtacactatactatgtgttttcatctgatttgcagtagatttcattagacctgctctttagtgtgtacgtgtatttcataaatggattcattgtgtattttgatgtttgtggaattattctggaaatagatttattttttcattcatcaggtttattacacaaaccgagggatgttcttatggggatccatggacgcagcagagaaagttaccaaaaacctaccacccagaaatagtcattgttaatatattgctacacaccctttcagatgatcaatccacatatatgtaaataggtcagtctcaacctgctactgtgtgttgcaccctattctgtcaaatgctgttcttacttgagaaaatgttgagcatactaggactagaactggcctgcacaggagacactttgcaaaatttaaagctcctacatggaccttctggaattgtgagtagcttgaaatacggattcttagggtatattgtacggtgatgccggggttagttgcacataggagtaatagttcatttctctgacacaattgcttccatttccaaatgcttaaattctaaagcatttagaaagagggacctgatcttttcctgtgaaaaagatgatcagatcatcattcagggcaatttccagagaggaaaatatagtctttaagtgttttcaatcatagaaaggaatcataatatattgattaatactgttagaaattttatgtatgtaaaagttacagcaaagtaaattttacaaacttaatatgtatgtataacaatatctgagtgtatatataaaagcacatacttaaatttacatgtacgtacacattattataagaatagctttgtgttaaactatttattttctataagctgtggaactatgtatgtttgtctcaatgtctgtgcacctctgcatgcatgcgtactgttcaccctggtaccttcacctacattcatatacagatatgttccatgcatcgctaattgatggttaatgctaagtgggagatgtctactgtggagcttttggagatggaaaattagctgcttttgatgtgaacaaagatacccaagagagttgaaaggcaaagcagcctcaagagaataaaggattgctcctttcaaagatatagtaaagttattttaaatatgaagatatatccttgtgcttgctagggaggcggataaacttcagacagaaggatttatatgtttaggggccttcagaagacactttagggatttaaggattagatttcttttggaaacaagaaggccagaggtctctatggtttggtggatcagagcatctcttctggagtcaaaaagtctttctggcctatttatagagaatgaggactgatctgtaagagaatccaaggactggatgttggcatctctgaccacagaagaaaaccaaatgttgctcctggtttgtgtagggaatttgactgagaaaaatcaagttgttttactcagctgagctgtgttggtgtttggctaggggtgtgttaagtaaatgacaaacagggctttctcttcaatcagcaatgatggttttctaaaatatatattgaaattatttctagatataattggcatggagccaaagagagaaattccttgaatcgatcagatcccatgaatttgctgttccagcttgtcaatcttgctgctttcttgttaattttctatttttgagtcacagaggcaagaattcggatcaatcctcgccaggtacttccatgtctccttttctgctgctgttattattattattagattatgatgagtcaatccaggattttagaatatggccctgtgactccctttgtatgtactcaatggacattccattattctgtggtgcaagacattctgtaaaagggtcagcaataaccgtgaaaaatcattattttagggtgaaggtggggaggcttcccattaccttagctcttctctttctgtggggttcagcttggaccttatttctatgtcaacagttctcccattctggtcactgtctcccctttaccgtctcttacccaggtgaacaaggccacttaaggaggacaagaggatataactggactggttatcatcgttcattctcttctcttccctctcccacttgtcctttaaaataatcatgaagccatgaactcagatatccataacattaagttaaaaattgtaccaaggaagcgctacagatataggctctgtgttctcatctacatcggctgatttaggggcctttcatgtgtttgcatcaggctctggcggctgtgaaaacagcaacagctgtaacctgccacactagaaaaaatacattcattgggtggatccccgagttctcacaggaggctggggcactgccgtgtaaagctagcgccctgccctcagaacaacttagtgtgtaaaacctaaaggagcttacagttcatataaaataatgacaactttgagctttttaagactttgaagggcgtgagtctaagataaaactgtgtggctatttttacagcatgtattggtatgccaaaagaaggtagcccagatagctcacgtgacaatttttgacatctaaatagaccaatacttgctcttgctctacattttatattcttttataacataactatatagttttagttataaatattttcctctctttttaaatggtgccacattatcagtacttcctgtgtccttttttttcttttgtgtctgtcatgagaaatattgaaaagtcttatatttaaaacaggatgttttgaatttgcttttagccttttcattcagaggagttgatccaaggtatccactcagacatggagattggcaactgtcaattactcaggagcttgtctgtgtagtttgtggaaaaaaaaaaacaacagttctcttattttgcctttcttatgcctgttattccttaatctcccttttctttttagcctgagcatcatataggaaaaagattctgaccttctacgttattactctattggcagctttgttgaaaagtttggtgagtgataaggttgtagttgaaattgtttctagatctttttaaatctccataagacttaaaaaattttgccttctattgggcatatctatcagccaggaaaatttctattttactttttgtactttgtattatgaaaaaatgttgtagtataatagtgtcatgattgaaagtggagacagaccaggcgcggtggctcacacctgtaatctcagcactttaggaggcacagatgggcagattgcttgagctcaggagtttgagaccagtctgggcaacatggcaaaaccccatctttgcaaaaaaataaaaataaaaaaaattagtggggcatggtggcatgtacctgtagtcctagctactcaggaagctgaggcaggaggatcgcttgagcccaggaggttgaggcttcagtgaggcctgatcatgccactgcacttcaggcttggtgaca

SEQ ID NO: 2905 - DNA, 4858 bp, Homo sapiens
  ENST00000637479
gctttttgtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctgtaagtgtggggggttgtccagatggaagcagagctctcggaacaggtctggtggataggcgtggaaaggcttttctcagatggctagctgcagtccgagaatatataggcactaaaagctgagtacggcacttcggttgggggtgggggttggggaaccatccgcatatgtcctaccgttctgtgctgttgaaaatgtctttgtggggtgtgtgggggttaacttgtgataagtgattattttcaatgttttcacacagtaagcttgtaataagatcatcttgcctagggacaattttattccgaataagagtaaaccattattatacactgttagcacctcacatccccacagtaggagagagatgttggtactgtgatgcaaggctttcttaagagtttggtccaaaagtagatgttatgctcccagtgccctagattttagtttgtaacctccgtgtttcacatactctatatgtgaagagagaggaaaaagaaacatgccgaaacacacttgagtcaggcattttagattctttttttttttttttttgagacggagtctcgctctgtcgcccaggctggacattttagattcttgagtcctgtggagcctttttgggcaagtccattaacttctgctttggtgtccaggagggtagttaagaatctggattacaaggaagtgcaaaagatcattcagtgccccacagcagggccccacttccgaataggagatttcacacagaacgtcaccttacttcttgtattaccttgacatagatgatggagtgtgtgcttccagatgaacccatacctagcccaggctggttccagtggatcatgcacatcgactcttcctacattagctgctatataagagctgcctattctaccttcactgtccccactgtgtgttaatacaagttctagtggccaagatttttttcatggactgagccccccatgtacactatactatgtgttttcatctgatttgcagtagatttcattagacctgctctttagtgtgtacgtgtatttcataaatggattcattgtgtattttgatgtttgtggaattattctggaaatagatttattttttcattcatcaggtttattacacaaaccgagggatgttcttatggggatccatggacgcagcagagaaagttaccaaaaacctaccacccagaaatagtcattgttaatatattgctacacaccctttcagatgatcaatccacatatatgtaaataggtcagtctcaacctgctactgtgtgttgcaccctattctgtcaaatgctgttcttacttgagaaaatgttgagcatactaggactagaactggcctgcacaggagacactttgcaaaatttaaagctcctacatggaccttctggaattgtgagtagcttgaaatacggattcttagggtatattgtacggtgatgccggggttagttgcacataggagtaatagttcatttctctgacacaattgcttccatttccaaatgcttaaattctaaagcatttagaaagagggacctgatcttttcctgtgaaaaagatgatcagatcatcattcagggcaatttccagagaggaaaatatagtctttaagtgttttcaatcatagaaaggaatcataatatattgattaatactgttagaaattttatgtatgtaaaagttacagcaaagtaaattttacaaacttaatatgtatgtataacaatatctgagtgtatatataaaagcacatacttaaatttacatgtacgtacacattattataagaatagctttgtgttaaactatttattttctataagctgtggaactatgtatgtttgtctcaatgtctgtgcacctctgcatgcatgcgtactgttcaccctggtaccttcacctacattcatatacagatatgttccatgcatcgctaattgatggttaatgctaagtgggagatgtctactgtggagcttttggagatggaaaattagctgcttttgatgtgaacaaagatacccaagagagttgaaaggcaaagcagcctcaagagaataaaggattgctcctttcaaagatatagtaaagttattttaaatatgaagatatatccttgtgcttgctagggaggcggataaacttcagacagaaggatttatatgtttaggggccttcagaagacactttagggatttaaggattagatttcttttggaaacaagaaggccagaggtctctatggtttggtggatcagagcatctcttctggagtcaaaaagtctttctggcctatttatagagaatgaggactgatctgtaagagaatccaaggactggatgttggcatctctgaccacagaagaaaaccaaatgttgctcctggtttgtgtagggaatttgactgagaaaaatcaagttgttttactcagctgagctgtgttggtgtttggctaggggtgtgttaagtaaatgacaaacagggctttctcttcaatcagcaatgatggttttctaaaatatatattgaaattatttctagatataattggcatggagccaaagagagaaattccttgaatcgatcagatcccatgaatttgctgttccagcttgtcaatcttgctgctttcttgttaattttctatttttgagtcacagaggcaagaattcggatcaatcctcgccaggtacttccatgtctccttttctgctgctgttattattattattagattatgatgagtcaatccaggattttagaatatggccctgtgactccctttgtatgtactcaatggacattccattattctgtggtgcaagacattctgtaaaagggtcagcaataaccgtgaaaaatcattattttagggtgaaggtggggaggcttcccattaccttagctcttctctttctgtggggttcagcttggaccttatttctatgtcaacagttctcccattctggtcactgtctcccctttaccgtctcttacccaggtgaacaaggccacttaaggaggacaagaggatataactggactggttatcatcgttcattctcttctcttccctctcccacttgtcctttaaaataatcatgaagccatgaactcagatatccataacattaagttaaaaattgtaccaaggaagcgctacagatataggctctgtgttctcatctacatcggctgatttaggggcctttcatgtgtttgcatcaggctctggcggctgtgaaaacagcaacagctgtaacctgccacactagaaaaaatacattcattgggtggatccccgagttctcacaggaggctggggcactgccgtgtaaagctagcgccctgccctcagaacaacttagtgtgtaaaacctaaaggagcttacagttcatataaaataatgacaactttgagctttttaagactttgaagggcgtgagtctaagataaaactgtgtggctatttttacagcatgtattggtatgccaaaagaaggtagcccagatagctcacgtgacaatttttgacatctaaatagaccaatacttgctcttgctctacattttatattcttttataacataactatatagttttagttataaatattttcctctctttttaaatggtgccacattatcagtacttcctgtgtccttttttttcttttgtgtctgtcatgagaaatattgaaaagtcttatatttaaaacaggatgttttgaatttgcttttagccttttcattcagaggagttgatccaaggtatccactcagacatggagattggcaactgtcaattactcaggagcttgtctgtgtagtttgtggaaaaaaaaaaacaacagttctcttattttgcctttcttatgcctgttattccttaatctcccttttctttttagcctgagcatcatataggaaaaagattctgaccttctacgttattactctattggcagctttgttgaaaagtttggtgagtgataaggttgtagttgaaattgtttctagatctttttaaatctccataagacttaaaaaattttgccttctattgggcatatctatcagccaggaaaatttctattttactttttgtactttgtattatgaaaaaatgttgtagtataatagtgtcatgattgaaagtggagacagaccaggcgcggtggctcacacctgtaatctcagcactttaggaggcacagatgggcagattgcttgagctcaggagtttgagaccagtctgggcaacatggcaaaaccccatctttgcaaaaaaataaaaataaaaaaaattagtggggcatggtggcatgtacctgtagtcctagctactcaggaagctgaggcaggaggatcgcttgagcccaggaggttgaggctt

SEQ ID NO: 2906 - DNA, 3088 bp, Homo sapiens
  ENST00000005284
actttttgcccgcctaagcgagccatagagccgtctccagagctgccggtgcctttaagaagactcggtctttcgggtcttctttttccccaatgggctccagtggtgcccgcagcaaaaggcaaacttgcctggctcatggggtgaaagggaggattgaagaatgccgcgttgggtgggtgctgagggagcgccagagtgcgctacgggcttcgctccccttcccctttccttaacccttcctagagcggaggaaccgggtcgtgctgcagcgcccaggagccagggcgctgactgtcctcggctccagaaactttgcgcggagagtgggcttgactgggcagagccgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccagtttgagcgggggtgtcgggagcaggcggagagctttcctgcgaggctgtggaagcagtgaacactcttctcagcggctcgcctcccagcagtgctattttttgccatccgccctcacccccagcacacgcgctcgcacacacacgcacgcacgcacacacacacacacacacactcacacagagacctctctgggtttctttgccttgagtctcccggggctgtgagaagccaggcgcatctcaaaccgagctggcagctccaggctccggagccatgccctgcacggaccctcgtctttaccacgctcctgaggaatgaaaggaacccagggaccctcagaaggcagcagtgatgcggaccaaccccccggagcctgcacccttccgagggccataggcgacccagggaactggagagagctccagaaaggaaatcccagctttcccaaagtccctgtggatgctgacaaaaggagacctgaatttttggaagagcctgtactaggttacccggctgcagagtgattttcccctccggcactgactctccccctccaacccccagccgtccagagtaccatgaagaattatgaggatgtgtgacagaggtatccagatgttgatcaccactgtaggagcctttgccgcttttagtttaatgaccattgcagtgggcacggactactggttatattccagaggtgtgtgcaggactaaatctacaagtgataatgaaaccagcaggaagaatgaagaagtaatgacccattcggggctgtggaggacctgctgcctagaaggggctttccgaggcgtgtgcaagaaaatcgatcacttccctgaagatgctgactacgaacaggacacagccgaatatctcctgcgagctgtgagggcctccagtgtcttccccatcctcagtgtcacgctgctgttcttcggcgggctctgcgtggcagccagtgagttccaccgcagcagacacaacgtcattctcagcgcgggcatcttttttgtctctgcagggttaagcaacatcattggcatcatagtttatatatcagccaacgccggagaccccgggcagcgtgactccaaaaaaagttactcctatggttggtccttttatttcggagccttctctttcatcatcgcagaaattgtaggagtggttgccgtgcacatctatattgaaaaacatcagcagttacgagccaaatcccactcggagttcctgaagaaatctacttttgcccgcctcccaccctacaggtatcgattccggaggcggtcaagttctcgctccaccgagcccagatcccgagacctgtcccccatcagcaaaggcttccacaccatcccttccactgacatctcgatgttcaccctctcccgggacccctcaaagatcaccatggggaccctcctcaactccgaccgggaccacgcttttctacagttccacaattccacacccaaagagttcaaagagtcactgcataataatccggccaacaggcgcaccacgcccgtctgaactgacctctgacctctgccccacgcccagcacagccttgggggaagtgtacagagatgtctctgaggttgcatggcatggtccttgtgatggtattactttttacaaagaatgaaaccaaatggactcagccctctcccacattttcccctcaccctccaagtcctaacccctccatcctctctaacttttcaagccaatcccttaatgtcattcctctctctgtgtatctgtgccagatgttttcctttcttccttctttactggaaggacctccacattcttccctccttggaagaggactttactaaaagtcacaggtggtggccaggggggatttccgaatctccatcaggcgcgctcatagttgtccccattgtctacccacacaaatcctcaggaaaccaaccaccgcccaggtggccctgagggaggcattcacctttatgtgttagaaaaacatgaccagaaatcaaagatgtcagagccccgaagcagctaatgtaataagcactcatgttattaaaggttttgccttgtcgtaaccaaccgagccgggggtgttttgtttcttgtgggtgtttcctacacaaactcactcccctgcctccaaactggctcatgtccatcttggaagctgaactttgctcatccacacttgagccactaggaaggatctccctgcacctttggaagctagtaaggcattcccacaaatgtccaaatcaatgcatccttctacttgaattcctggaggctacctgggggtgggtgagtgaatgctggttttcaagatctaactttggcatgcaatagctctagaaccttgggcaagtcacctaagcctcaagcctcagtctcctcatctgtaaaatggaacatgataatagcactctcctccacagagttatgaggtttaaataaaactgtgtgtaaaa

SEQ ID NO: 2907 - DNA, 3380 bp, Homo sapiens
  ENST00000262138
ccatggtgcgatgcgaccgcgggctgcagatgctgctgaccacggccggagccttcgccgccttctcgctcatggccatcgccatcggcaccgactactggctgtactccagcgcgcacatctgcaacggcaccaacctgaccatggacgacgggcccccgccccgccgcgcccgcggcgacctcacccactctggtctgtggcgggtgtgctgcatcgaagggatctataaagggcactgcttccggatcaatcacttcccagaggacaatgactacgaccacgacagctcggagtacctcctccgcatcgtgcgagcctccagcgtcttccccatcctcagcaccatcctgctcctgctgggtggcctgtgcatcggtgctggcaggatctacagccgcaagaacaacatcgtcctcagtgccggcatcctcttcgtggctgcaggcctcagtaacatcatcggtatcatcgtctacatttccagcaacacaggtgacccgagtgacaagcgggacgaagacaaaaagaaccattacaactacggctggtctttttactttggagctctgtctttcattgtggctgagaccgtgggcgtcctggctgtaaacatttacattgagaaaaataaagagttgaggtttaagaccaaacgggaattccttaaggcgtcttcctcttctccttatgccaggatgccgagctacaggtaccggcgacggcgctcgaggtccagctcaaggtccaccgaggcctcgccctccagggacgtgtcgcccatgggcctgaagatcacaggggccatccccatgggggagctgtccatgtacacgctgtccagggagcccctcaaggtgaccaccgcagccagctacagccccgaccaggaggccagcttcctgcaggtgcatgactttttccagcaggacctgaaggaaggtttccacgtcagcatgctgaaccgacggacgacccctgtgtgagccgcctgccctttctctccgctccagcctctccccagaacggctctttttgtcacacaggatggcatgtgatcctcaagacgacgaacaatgaactaaagccaaatgcagccctccctggcctccagaggtggcgtgggctggctttgcacgaaggttgtgctgggagaccggacccggggctgcagaagaagctgaaggctgactttgtcccctccccgaaaaagggtgttttgatgcctcagggtctctgaaatctcccgggaagccccagagctttcctgaggctgcctggccttgatcaacttgggaagacaaaattgagccattatctcctcttggaaacgaatcttgccagaaaaacgggatttcagggccttccctccctgcctgggtgtcgggccaccagaaggctctgccggacgccaagaagacggtctctgggctcttgtcagctgcttttgaacctgaggttcctgcgtcgttgagccagaaatcagaccaccgaagctcactcccttcctctccatctctccctctctccaagactctggcagtggcctatgatcctgaagacagctctgcagccaactggtgctttggcctttgcgctgtcccggggccagcttccctcgacctggggaggccgtggcctgtggaggaggcccaggtaaaggctgggggctgttgctggctatcctctttgcttctggaagtttctgcctcactcagaatgggcaggacagacccactgactggacttcagagtctggagggttccatcggtcaggggaatggcggccacgtgacctcttgccgtgccccttgtcatagacccaaggagcaactctgtcccctgagcgttgggggtcccgggggagaggtggacagacacctccctccaactggcatttggcaacaggagcctggacttctgtgcaagaaagggagacctaagggtgaacagtggccaataaaaaccctagagaacaaacatccatttcctaggtggttacaaatcataacttcctgcaaatcaacgccaggagagcaacttaccttcatttctttgtcttaaaaagtagcagcaactggccccacaactcctgtcattgtaagttattctgccaccacctaacaggacggagtggagtgagtttggataaacggaccgagctgggcttctcttcctccctacagaggggagatctcagcactttgtccggagctgaggaagtggtttctgtgttttacagtttttccagccattcttttcttccccctcctgaagcaagcaaagagcgtggaggcgtgtgcaggcttggaagaagaactctccagaacatggaacttaaccctcttttgtataaaacatgtgctttctaaagaaaaattgtttcttattttttgagactccttgatccaccctggaacagtcgcctgtagtcctggtagctgttgtgcttggaaataacgagcgcatccttgcctcagctacctgctcacagcccatgggtggactcggccccctggggttcagacccaggtccgttcggcctagtgatgatgtcatcgtccatcccatcttcctttgcccccaggaaaggacgcatccaccggtagcggccccagctgactgtcgccgtgtgctggggatctgaaatgaggcctgccagggcccctgtgtgctgtgctccagagccttcgctcccatcagggttggcatcatctgatggcatgtccaagtgtgcccagcagcggatgctgaagcaccagagctcaaggccttcacctgctctaggccagccctgtcaccacctccactgccatgaccaggccgaaggcagggaacgccctccccagtcccgctgtccagcaaggccccgagacttttcttctgtgatttccaaaagcaaggcagccgtgctgttctagttcctctccatccgccacctcccctcccgctgccccagaagtttctatcattccatggagaaagctgtgttccaatgaatcctacctcttgcccagtcccaggcagagtaagcagggcccacctagggaccaagaaagagtaggaagaaggggacgagccgggagcaaaaccacctcagacacccgggccttctcagccttctccccgcggccagctgggtctccggggaccctgggccctgggccgcccattcctggccctcccgctgcatctcagacctgacacccaacggggggatgtggtggcctgtgcccaccttctctccctcctcccgacccgccccctcgcccccacccctgtgtgtttcgccagttaagcacctgtgactccagtacctactactggttttgggttggttgttctgtcttttttttaattaaataaaaacatttttaaaa

SEQ ID NO: 2908 - DNA, 1311 bp, Homo sapiens
  ENST00000533854
attggcgccgagcggttccggctgactggacggggcgggcgtcccgggcagcctagcgcggtacctcccgccccgcgcgcccagccggcgagggacattggaccagggtcgggggtcgcggccgctccagcgagagccgtgggtactgccacctgctcacccactctccctagccccagagcgcagtccgtgctggtgggagcgtggcgactagttgcacagcaacggtccaggaagatgagtgcctgcgggaggaaggccctgaccctgctgagcagtgtctttgctgtctgtggcttgggcctcctgggtatcgcggtcagcaccgactactggctgtacctggaggagggtgtgattgtgccccagaaccagagcaccgagatcaagatgtccctgcactcaggcctctggcgggtctgcttccttgcaggtgaggagcgggggcgttgcttcaccatagaatatgtgatgcccatgaacacccagctgacatccgagtccacggtcaatgttctaaagatgatccgctcagccacaccattccctctggtcagcctcttcttcatgttcattgggtttatcctgaacaacatcggacacatccgtccccaccggacgatactggcctttgtctctggcatcttctttatcctctcaggcctctctctcgtggtgggcctggtgctctacatctccagcatcaacgatgagatgctcaacaggaccaaggatgcagagacctacttcaactacaagtatgggtggtcgtttgccttcgccgccatctccttccttttaacggagagtgccggggtgatgtctgtgtacctgtttatgaagcggtacaccgcggaggacatgtacaggccccaccctggcttctaccgccctcggctgagcaactgctccgattactcaggccagttcctacacccagacgcctgggtcaggggccgcagcccctccgacatctccagcgaggcctccctgcagatgaacagcaactaccccgccttgctcaagtgccccgactatgatcagatgtcctcttcaccctgctgagcctcggccgcccccatccctggactgtgggtggccagacaacccttcctgttctctccaggtgacccctgagccccaggcctgtggttgacaggcccaggccacccatgcttagctgttgtcacttgaccccagtcctctccctgcttctccagaagggctctaactgccccagcatgggtgtgggagtctggagtctgtgggcaagctgattgtctgggaacatgggagaagccccgcccatgt

SEQ ID NO: 2909 - DNA, 926 bp, Homo sapiens
  ENST00000307139
agagcgcagtccgtgctggtgggagcgtggcgactagttgcacagcaacggtccaggaagatgagtgcctgcgggaggaaggccctgaccctgctgagcagtgtctttgctgtctgtggcttgggcctcctgggtatcgcggtcagcaccgactactggctgtacctggaggagggtgtgattgtgccccagaaccagagcaccgagatcaagatgtccctgcactcaggcctctggcgggtctgcttccttgcaggtgaggagcgggggcgttgcttcaccatagaatatgtgatgcccatgaacacccagctgacatccgagtccacggtcaatgttctaaagatgatccgctcagccacaccattccctctggtcagcctcttcttcatgttcattgggtttatcctgaacaacatcggacacatccgtccccaccggacgatactggcctttgtctctggcatcttctttatcctctcaggcctctctctcgtggtgggcctggtgctctacatctccagcatcaacgatgagatgctcaacaggaccaaggatgcagagacctacttcaactacaagtatgggtggtcgtttgccttcgccgccatctccttccttttaacggagagtgccggggtgatgtctgtgtacctgtttatgaagcggtacaccgcggaggacatgtacaggccccaccctggcttctaccgccctcggctgagcaactgctccgattactcaggccagttcctacacccagacgcctgggtcaggggccgcagcccctccgacatctccagcgaggcctccctgcagatgaacagcaactaccccgccttgctcaagtgccccgactatgatcagatgtcctcttcaccctgctgagcctcggccgcccccatccctggactgtgggtggccag

SEQ ID NO: 2910 - DNA, 8747 bp, Homo sapiens
  ENST00000270458
ccccgcttctgcctgcgctgtgaacccccccccagccgccggcacggccccgcccccgctgccccggtggtggcccacggccccccggctgcccgtggtcaaactggagtcgctgaagcgctggaacgaagagcggggcctctggtgcgagaagggggtgcaggtgctgctgacgacggtgggcgccttcgccgccttcggcctcatgaccatcgccatcagcactgactactggctctacacgcgcgccctcatctgcaacaccaccaacctcacggccggcggcgacgacgggaccccccaccgcgggggcggcggcgcctcggagaagaaggaccccggcggcctcacgcactcgggcctctggaggatctgctgcctggaagggttgaaaagaggcgtctgcgtgaagatcaatcatttcccggaggacacggactacgaccacgacagcgcggagtatctactccgagttgtccgggcctccagcatcttccccatccttagcgccatcctgctgctgctcgggggtgtgtgcgtggcggcctcccgcgtctacaagtccaagaggaacatcattctgggcgcagggatcctgttcgtggcagcaggcctgagcaacatcatcggcgtgatcgtgtacatctccgccaacgcgggcgagccgggcccgaagcgggacgaggagaagaaaaaccactactcgtacggctggtccttctacttcggcgggctgtcgttcatcctggccgaggtgataggcgtgctggccgtcaacatctacatcgagcgcagccgcgaggcgcactgccagtctcgctcggacctgctcaaggccggcgggggcgcgggcggcagtggcgggagcggcccctcggccatcctccgtctgcccagttaccgcttccgctaccgccgccgctcccgctctagctcccgctccagcgagccgtcgccgtcgcgggacgcgtctcccggcggccccgggggcccgggctttgcctccacggacatctccatgtacacgctcagccgcgacccctccaagggcagcgtggccgcggggctggcgggggccggcggcggcggcggcggcgccgtgggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcggcgtcacggtcacggtcaccgggccgcccgccccgcccgcgcccgcgccacccgcgccctctgcgcccgcccccgggaccctggccaaggaggccgccgcctccaacaccaacacgctcaacaggaaaaccacgcctgtgtaggggcgcggcgggggagccgaggggcgtgtccggggcgcgtgcgcgggcgcgcgtgcatcgaggctgccggggtcgggggcgcccccgctttcccccgtgagcgcgctggagactgctgggcccgccccacgcccaccctccccgcccccctccccctccgaagcagggaccccgagggagggggcaggggagggagggggccgctgtgagggagcgtcgtgttttatttttttgggggatctatggggaggggggagggccatggtgttttttgcagtttcgagatgttttctttttcatgttttgctgtgtgcatggggggcggggcggggggaggggagggagggactcccagcccagcccaactcctggagaggggcccataatacacgaatacatagttacacccacaaactatatatatgccctatataaagagacacagcgaagggatgcagaaaggcagaaagaagggttggacgcgggcattcattcatttttttcattcattattccacaagggcttattaagcacctactgtgtaccaggcactggtacataagaaggcattggagcaggggacacgaacgaggcacagaaagggccttctcattcattcattcattaccggcaatttatttgtgcgccttaaaaagctaggcattgtgctccgtgctcagcgtgcaggaggcaggaaaacagccaggggccccgacgtctcatagagtaaacatcttgtgcatgagacaggcattaatcgatcatgtacatacacaataaattacagttaggctataggagaaacgagatgctatgaaatgctccatcaggggagcctaacccagttgtgaggaagagatttcagtggacagtgaaaggatgagaagaagccagcagggcggagctggggcaggagtgtggcaggcagagcagcacgtgcaaaggccccggggcaggaaggagcttgcagcgagggctgaagggtagtgaggcaggtgagcggggatcaaggtgaggccggagacacagacagggccagattgtgcaggggctcgtaggtcaggagttcagattttattctaggagtggtgagggccgtggaacgggtttaagcaggacgctaacgtgaatggtgtacaaagggaagacaggaactcggaggcaagagtaggaggcagagatgtgctgaaatacagcatcaaacatgggcacgggcccttggagctcacactcttgtgggaggaagcacgtaattacacagatgctgaagcatagtcatggtgtctggtgtgcaggagaaagccgtggggcttagagactcatgtgtctgtcactcgttcattcagccactcacccattgccatttttggccatctgctaaggtaccaggaagtgtgttaggatccagatccccaggggtgaaacagactctagccctgctctcaagcagtttattgtcatcaaacaccgccatccaggcagggcaatcggtgctggaacccggaccaccgtgggtaccgtggcacacggtggacagagtgaccaactgccaggagtgagcagcacttggggtaggcttcctggagaatatgatgcccattctgggtcttgaagaaatgagtgggcatcttctggttgatgaaaggcatgagaaaggcttgtggggccaaagaacaacttgggtgaaaacgggaggaagtgaacgagcatgatgtattggggtcagtgctaacagttctgggatgctgatgtacaaggtggggctgggagatgaggccgggaaagtagccacaagctagagtgtaaaggtaccagggtggccgggcgcggtggctcatgcctgtaatcccagcgctttgggaggctgaggctggagtatcacttgagcccaggagtttgagaccagcctggataacatggcgaaaccctgtctctacaaaacattaaaaaaaattagccgggcgtggtggagcacacctgtggacacagctactcaggaggctgagggaggaggaccatttgactccaagagttcgaggctgcagtgagctaggatcgcggcactacactccagcctgagcaacagactgagatcctgtctcagaaaaaaagagaaaaaggtgcctgagttccaggcagagggactgaggctcttctaaggatggtgagagaggatgacagctgcgcgggggcaagggctgtgcggtgattggaggggatgggtttgaagttcactgagaaggcagaggggacagcgcccagtaggcttcccttccatatttgctcagcaagtgtttcctgaggcctcccccgaagccttgtgctgggcggtgctgggagtggagaggtgattttgatcttgccctgctctcaaggggctcccagtctggcgggaaaacaggcacagacgcagcttgaggaggacgtggcagcggtggtgccatgctgccaggggctctgcgtgcccttctcttgacggaagggtacagatcagagctgggtgttcagaatttctctccgaggcctgtgtggaaggaccaggaagagagagactgaaggtccctaggaagaattctgccaaggcggtttcaggaagagatgctgggaaatgtaggaaaaggaatacaaatcagtgagacggagaagcgctgagtgagagagacggatacgtggagagaagagggatgccggagcgggtgttaaaagagacaaatctggccgggtgctgtggctcctaatcccagcactttgggagactgaggcaggcagattgagctcaggagttccagaccagccaacatattgaaatcttgtctctaccaaaaatacaaaaattagccgggtgtggtggtgcacgcctgtagtcccggctactcaggaggctgaggtgaaaggatctcgcttgggcctgggagggtgaggctgcagtgacccgtgatggcaccactgcgctccagcctgggcgaaagagcgagactctgtctcaaaaaaaaaaaaaaaattgagagacagcaaatatttgctggaagagggagagggaactggttaggggagaatggattctagagtctgaaggccaaacagaacgagagagagagagagagagagagaaagaatgaggttgagggtaggcaggaggaagagcaagatggggagggagggggagagcaggagagaccaaactagtagagtcacagacagagaaaaagtcaaagacaggaaggtgatacagaggagagagaagaggaagaggagagactgacaggtgcacaaatcagagaagtcccagagatagcagaaacacacacagagacagagatagagagggagaggtaagccggagacagactcagagattcgcacaaaaagcaacgtggagactcagaagcaagcgcagcgtcaaggaatgctccatttctggtgtgttgttttcccagtattcaagaaatatttattgagtgccaacctgttctagacccaatctcggccaggggatgtggtggcaaatagacggacaagggcctgctctcctgaaacacactggagagataaacaataaataatatcatttcagtaaccaaaaagtgctttaaaaattaagctgaaggccgggcgcagtggctcatgcctgtaatcccagcactttgggaggccgaggctggtggatcacttgaggtcaggagttcgagaccagcctggtcaacatggtgaaacttcatctctaccaataaataaataaagtagctgggtgtgctggtgtgcctgtagtcccagctacttgggaggctgagaaagaaggatcacttgaacccaggaggcagaggttgcagtgagctgagatcgcgccactgcactccagcctgggcgacagtgagtggtaacagaatgacagagcaaggatgactttagatgaggtccttggagtagaccttgtggcagaggtcacagagatgtggattgtgagtaggaaagagaggtgagaaagtctgggggccaggcattccacccaccagaggcagccccaaagcccagaaaagtagcaggtcttcgaggaggcctgtgcggtgagcagatccaccataggacagaggcacagggtaggggctgatcagttagggccttggatccttgggaagaaatctgaattttattctagatctgatgggaagtgcttggagggttttgagcacaggcatgccatgatcatatttttattttcttatttatatttattttgaaaaagagtcttgctctgtctcaggctggagtccagtgggctgatctcggctcactgccaacctccgcctcccaagttcaagtgattctcctgcctcagcctcctgagtagctgggattacaggcatgtgccaccacgcctggctaatttttttgtatttttagtaaagacgggatttcaccgtgttggccaggccaatctgaaattcctggcttcaaatgatccacctgcctcggcctcccaaaatgctgggattacaggagtgagccactgcgcccggcctcatatttttatttaaacaagaacagcagaattacattgctgtgctgagcatacgtagacttcaggagtcaaaggggaaggaaggaggtagcgggctgttgccttcctctggttgctggaggcctggaccaaggtggagttagtgggatggaggaagtggaagaaggcatgggattttggaggctagagcctgcattggtggtgaactggatgtcatagaggagggaaggaaaaggaaccaggaagagaagaactctctgaattgggcacgcacatctctgatgggcaccgatgaggattgttaccaggaacgaggagactgggatcaggaaagtggctttgggagggaggaaccaaggcttctcttttggatgtgtcaagatagatctgccttcgagaaatccgagttgtggtatcaaatagccagttggatatgtgagactggagtttgggggaaagagaggccgtggctcaaaaacgtaagttttggaaacgtcaacataaagccacaggattgggtgacgtggcctagcaggggggtggggacagagaagcgaccctggccagagccttggggacatctacatctgggggagaaggggatgtagcaaaacgagcttaggagtgatctcgaggtaggctgaaaccaggagggttacagagggcaaatgcacctttgtgtttcaagaaggagaggagacagccagctgtgccaagggctgctgagacttggacaaggatgcagagagcagagtgaccattaggtctgatgacatggacagggttggtgatcttgataagataagatgtcagttcagtgcagtggtggggacagaagccctgctggagtggaggggagagagaatttggggggaagacagaaggaaagggaattcaggcaagtgtgtgtgtgtgtgtgtgtgtgtgtgtgtgtgtaactgacacaaaggccaggtgcgatggctcacgtgtgtaatcccagcactttgggaggccgaagtgggtggatcacttgaggtcaggagttcgagaccagcctggccaatatggtgaaaccccgtctctactaaaaatacagaaattagacaggtgcggtggtgcacacctgtaatcccagctacttgagaggctgaagcaggagaatctcttgggcccaggaggcagaggttgcagtgagccaagatcacaccactgcactctagcctgggtgacagagcaagactctgtctcaaaaaagaaaaaaggtaaaaaaaaaaaaaaatgaccctgaaaggaagtagggagacatgcagatagggagatgggaggcagaaaattgcatcctgcaattagctgtcacagcaggcaggagcaagagagatggggaagcccagggccaggaggggaagatgaattcagggggcagggaagagaggatgctgtcagctaggctctggcagatcccctagccagggatgctctgcccagctcctgtctcttgctgctgtcagcgccgggcacactctgggattccccctgtagaccctgtcaagacctattgaggtgaaggggaagaacacgttttcatcattcattttcagaaataaacattcactcagttcttggaaatactttctggccaggcttgggggctcatgcctgtaatcccagcactctgggaggccaagacaggaggattgcttgaggcttggcgtttgagaccagcctgggcaatatagtaagaccccgtctctacaaaaatgaaaaatgagctgtggcgtggtggctcacgcctgtagtcctagatactcgggaggctgaggcgggaggattgcttgagtccaggagtttaaggttgcagtgagctatgattgcaccattgcacttcaggctgggccacagagcaagaccctgtctcagaaaacagaaagaaagaaagtcaaagaaataaagtcaaagacaagaaggtgatacagagaagacagaaaaggaggaggagagagactgacaggtacacaaatcagagaagtcccagagataacaaaaacacaaccacagagatagggagacgtaagccggagaaagacccagagattcgcatagaaagcaacgtggagactcagaagcaagcacagcatcaaggaatgatcaataaaaagaaaaaaaaatatttcctgaggacttccaagtacaaggccctgcaatctcaggccacttctgtcccatctctgccttcagagggggggacaggtagtccagacaattagaatacagagggggctgtgttctgacggggccacgcgggcattgaggaaacgcagcaggcccctcccctagctggggcggggatgtctgtgtgccatcatctcactccatctggtcattcctttgcccattcatccatccattcattcaagtcaccccatgcacattttccaagactgcctgtgacctggccctgtgccgggtagagctgaggatgccaaggtgaattcctcctgtgcctggccccggccccagtctgctggaagaaccagacacagacaatcacactgcggggaaacacgtgctccatcggaaaagtccagagcagggggtgggcagagaggcccagcgtgcaccagagcctcgctcaggtcagcgccaggcctgcctggagcagccaactgtgggagaagaaggagttggtgaaaggtgggtcccacctgggccgtccacagaagggctgaggggtagggggtgaggggttgaagatcaggccctgccgccatgccacacggctgtcctctgtccctgctcctgggggagctgaaactgcatggaaggtcccccaggggtgccccgtctaataaactcgatgaagagga

SEQ ID NO: 2911 - DNA, 1278 bp, Homo sapiens
  ENST00000638874
ctggagtcgctgaagcgctggaacgaagagcggggcctctggtgcgagaagggggtgcaggtgctgctgacgacggtgggcgccttcgccgccttcggcctcatgaccatcgccatcagcactgactactggctctacacgcgcgccctcatctgcaacaccaccaacctcacggccggcggcgacgacgggaccccccaccgcgggggcggcggcgcctcggagaagaaggaccccggcggcctcacgcactcgggcctctggaggatctgctgcctggaagggttgaaaagaggcgtctgcgtgaagatcaatcatttcccggaggacacggactacgaccacgacagcgcggagtatctactccgagttgtccgggcctccagcatcttccccatccttagcgccatcctgctgctgctcgggggtgtgtgcgtggcggcctcccgcgtctacaagtccaagaggaacatcattctgggcgcagggatcctgttcgtggcagcaggcctgagcaacatcatcggcgtgatcgtgtacatctccgccaacgcgggcgagccgggcccgaagcgggacgaggagaagaaaaaccactactcgtacggctggtccttctacttcggcgggctgtcgttcatcctggccgaggtgataggcgtgctggccgtcaacatctacatcgagcgcagccgcgaggcgcactgccagtctcgctcggacctgctcaaggccggcgggggcgcgggcggcagtggcgggagcggcccctcggccatcctccgtctgcccagttaccgcttccgctaccgccgccgctcccgctctagctcccgctccagcgagccgtcgccgtcgcgggacgcgtctcccggcggccccgggggcccgggctttgcctccacggacatctccatgtacacgctcagccgcgacccctccaagggcagcgtggccgcggggctggcgggggccggcggcggcggcggcggcgccgtgggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcggcgtcacggtcacggtcaccgggccgcccgccccgcccgcgcccgcgccacccgcgccctctgcgcccgcccccgggaccctggccaaggaggccgccgcctccaacaccaacacgctcaacaggaaaaccacgcctgtgtag

SEQ ID NO: 2912 - DNA, 2835 bp, Homo sapiens
  ENST00000613570
cattttctttgatggtaaacaggctcacttataccgaatccaaacccaggcgagaactacggactcttgaaatggtcggtgaaaggggcgaaagcaccaggaaatcgtgcttcaacagtccatgactgaaaggagggcctgaaactgtggccataggcgggcccttttgttagggccttgacctgggcttccgctacagggcccggtcacgaggccaacgtagctccacctcctacggcggccagtgatgacgccaccacgtcggaactgttagaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcgctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcattagaacagttttatgatttatttgtctaggagtatgtcagaaaaatcaggcttttagtaggaattactcctattccccctgaagtcaggaccagtgcctgtgatctccattactttattttcctggaggtattagccaacacagttagatcagagaaagcaattgaagccaggcatgaaggctggcgcccgtaatcccagctactaaggctggaggatcacttcagcccaggagtttaaggctgcagtgagctatgatgatgccactgtactgcagcttgggtaacagattgagaacctgtctcattaaaaaaaaaaaaaaaaaaaaagccgttagacacacaggaaaaatccagaagggtaaactaaactaaagctacaattaatatgggaatttggaagaagtggtaggatttaaaatacagaaacagtttatgtataggatagctataagtaaatactgaaacacattatgcctctgtaattggggttgacacatgaacagaatagcagacacaatgcatatgaaagttacagaatatggtaaaagtggggtaaagatgggtttttaatgatactaagataactgaaaataggcatatagatatattccaagccgcctgacgatctaattgtaaaaagtaaagcatacaaatactagaagaaaatggaggaaaacgacattatatgtgacttaaaacctagaagaaataaataaaactattgatcaattttaactacataaaaatgtttataggacaagaaaaaccccaccataacccaaggcaaacaatgtattgacaggattccaataattaagaatacttcatacaaaaagaaatgtaaatgacctttaacatgtaaagatgctcaccttgttcagaagagaataaaccagtgtttttacctttcacttg

SEQ ID NO: 2913 - DNA, 499 bp, Homo sapiens
  ENST00000426793
agaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcggcgtctgcgctcggtttgagggctcggcgcggggtttcctgttcctccttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaa

SEQ ID NO: 2914 - DNA, 574 bp, Homo sapiens
  ENST00000461977
gaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcgctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggtatgacttgcttccctatagccagttctgcctccgagcaacctattcctcatagtggtctaacaaattcatccccaatgagttttgagtctgtgtttttggtggtttggagcaagacccatcagtttttattta

SEQ ID NO: 2915 - DNA, 2766 bp, Homo sapiens
  ENST00000367679
gcgactgcgcagcgtggcccagcgcggtcaaattataatacataaaagttgtcagggcggagagcaagacattactcttctcggattgccggttcgctcgcgagacttgagcgttgctaggagattcggcaggcgggcggagccagactcggcggggcggggaggggtggggctaggctcggcgaggcgaggaagggtgggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttcctccttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcattagaacagttttatgatttatttgtctaggagtatgtcagaaaaatcaggcttttagtaggaattactcctattccccctgaagtcaggaccagtgcctgtgatctccattactttattttcctggaggtattagccaacacagttagatcagagaaagcaattgaagccaggcatgaaggctggcgcccgtaatcccagctactaaggctggaggatcacttcagcccaggagtttaaggctgcagtgagctatgatgatgccactgtactgcagcttgggtaacagattgagaacctgtctcattaaaaaaaaaaaaaaaaaaaaagccgttagacacacaggaaaaatccagaagggtaaactaaactaaagctacaattaatatgggaatttggaagaagtggtaggatttaaaatacagaaacagtttatgtataggatagctataagtaaatactgaaacacattatgcctctgtaattggggttgacacatgaacagaatagcagacacaatgcatatgaaagttacagaatatggtaaaagtggggtaaagatgggtttttaatgatactaagataactgaaaataggcatatagatatattccaagccgcctgacgatctaattgtaaaaagtaaagcatacaaatactagaagaaaatggaggaaaacgacattatatgtgacttaaaacctagaagaaataaataaaactattgatcaattttaactacataaaaatgtttataggacaagaaaaaccccaccataacccaaggcaaacaatgtattgacaggattccaataattaagaatacttcatacaaaaagaaatgtaaatgacctttaacatgtaaagatgctcaccttgttcagaagagaataaaccagtgtttttacctttc

SEQ ID NO: 2916 - DNA, 688 bp, Homo sapiens
  ENST00000483307
ttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttcctccttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggtatgacttgcttccctatagccagttctgcctccgagcaacctattcctcatagtggtctaacaaattcatccccaatgagttttgagtctgtgtttttggtggtttggagcaagacccatcagtttttatttaataaaacttttttaagatataaataggaaaggatgcgttctagaagctgttaacaagagtaaggtgattcactacaaaatgt

SEQ ID NO: 2917 - DNA, 804 bp, Homo sapiens
  ENST00000473925
gtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttcctccttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagtgagtctacttccatttttttaaagaattttagtgtattgtttgaga

SEQ ID NO: 2918 - DNA, 243 bp, Homo sapiens
  ENST00000406752
atggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggatgggatcagtcagataagtttgtga

SEQ ID NO: 2919 - DNA, 1059 bp, Homo sapiens
  ENST00000405362
atattccttatgccccccggctggagctgcagcgccagcctcccgccctaccgccgtttccgtgggctgagccgccctgcggccacccggtcccgcgccagtcagtgcgccgccttcccgggggacacctcactcgccccttgctgcgccgtcggctccccagcgcttccactcgacctcgcaccccactcgcctgctgggctcgagcgggggtgtgcggcgattatccgtgcaggcggtgcggggagtgggtctgggagagcggccctttgcgcgtgttcctcaggccctttctgccctggtttcccagccagtggacaggaagcttcattcaagcaaagctgggtgcaaacatgagtgtcgttcttggtagagggcggttggaagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttga

SEQ ID NO: 2920 - DNA, 904 bp, Homo sapiens
  ENST00000469173
catttctcaacctagaaaatttcttatatttcaaattttttcatgtttatatgactggattttcataattttactttcctgacttatgagccatgtgcatttgctgttctaaagatagtttcagaggcttacttacgtcccatcttttgttgtcgttgccaggatgggatcagtcagataagtttgtgaaaatctacattaccttaactggagttcatcaagttcccactgagaatgtgcaggtgcatttcacagagaggtgagttctcattataatgggaaagacagtgaattaacagtcaacattgccttatcttgagactctcttctttgcagtttttaaaattcttaaatttagaattaattatcctttacaactactttgaagaggtgagcgttaactggccaaatgcacaccctgaaataaagccagcagcttttttcccacaagaactatggagtaagggtacctttcatagaactagaaagatgatgtattcaccattgtgttgcaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagtgagtctacttccatttttttaaagaattttagtgtattgtttgagatcatggatttttaatagtttgtctttatggataatgtatttctgctttcaactgtcaaactacctgaagagggcacgtccagcaagttgctttttaaggtctttgtagttaagggttggctctttagtgtggttcttaaccct

SEQ ID NO: 2921 - DNA, 2546 bp, Homo sapiens
  ENST00000368124
agcgccggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacggctactggcaggagcaggatttggagctgggaactctggctccactcgacgaggccatcagctccacagtctggagcagccctgacatgctggccagtcaagacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttccttggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaacaaaaccctggagtgttaggaggagagtgaaggtagaggggtgaggaagggtaaggggcagggctggtttcagctgggggctctcaccagccctcctttcagcctctacaacagagcagcttcccagacttctccaggaacccagaaacgggatggttgtcggcaaaggttgggagtggcttttcctctggtagccacacacctgagcactacggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgca

SEQ ID NO: 2922 - DNA, 3745 bp, Homo sapiens
  ENST00000368125
agcgccggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttccttggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaacaaaaccctggagtgttaggaggagagtgaaggtagaggggtgaggaagggtaaggggcagggctggtttcagctgggggctctcaccagccctcctttcagcctctacaacagagcagcttcccagacttctccaggaacccagaaacgggatggttgtcggcaaaggttgggagtggcttttcctctggtagccacacacctgagcactacggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgcagtgagctgtttcctgcccaaactaagggaataatgtgaactgtgtgcatgtgtgtggtgtgtatgcatgtgtgcatgtgtgtgtgtgtgtgtgcatgtgtgtgagtgagtgagaggcagagcgaggaactgaggaggagggctaagagccaggggtcctgggcaagtggacagggctgtgggacatgttggggaggctttgggaatggggtattcctagtcagggttcacacctcacctgggatgttgttccatgctggtatttcctctgccacccccaatgcccatcggtcttggagaaaggagtccccgggtgtgtgtttgcccagctgtccattctatctctcccttaaacacagagcattcagcccttccctggatttccctcctctgagccatggagtcagtgccacagcctttgctatgcacctctcaggcctctccttggcgttgaccctggaaagacctaccaccacctattttttcccatagtctgtacccagtgagttgaaggctgggtccccacccttccttttgatttcctgtcttccttctcgtggccccagctggttgctgtggagatgaggttcctggtcctccctgtcctggctggactgccccgcctcagatccaggatgcccttggcatcgctcccaccctcccccagcttttcctccctggtctgacaatgggcatgcaaaaaggggcagctgcaatctagcaggcctgcccacccccttcagttcaggtaatacagttgtgaatcttccagccgctggttagggccttgggcaccacaggcagcccctcacctaagccggggcctactcctcttacaacagcaagagagccctggggccccaggcctgttgagcttcttgtctcccagcacccgcttttgggaaaatgacttttcctcttcaagctgaaccactctgtccatattacacagaagccatatttgtacgggggggtgggagggagaggggctgttgtgctgtgtgtgtctgtccaggggtgggggggtgggggaagggagcagggaggggaccgtgtatctttataatctttctaactctcctgtgctaatctcagaggggtcaccctcaatatatctggattatccgtgtcattcagctgcctcctttctggtcctcttgctgctgctgggatgtgtgtatgtgagggtcttcttcccataccccttgcacctggtgcctggtgcctcaaaaggtggtgtgtcccttgccaggccactctcaagaatatctatgtacagcaacaatataactctacaaggga

SEQ ID NO: 2923 - DNA, 711 bp, Homo sapiens
  ENST00000416746
aagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatgacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccagga

SEQ ID NO: 2924 - DNA, 5471 bp, Homo sapiens
  ENST00000383710
acagcttgcaacactcggcatcttttctggaggcgcctccttcagcagccgcagatggcatccggctgcgggctcggggctcgcaattgattctcccccttgcccacctcgagtccacggacgcacctctcccttcccctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagagaatcaaaaggatgcagaaaatgtaggccggttaatcactcctgccaaaaagcttgaagatacaatacgtcttgctgaactagtcattgaagttcttcagcaaaatgaggagcaccacgcagagccacatgttgataaaggagaagcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaagagtttaaccagtaacctacccaatgtgaacctacccaatgtgaaccttcccaaagtaccaaatctaccagttaacatccctctaggcatcccacaaatgcctactttttcggcaccgtcatggatggctgctatatatgatgcggataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaatat

SEQ ID NO: 2925 - DNA, 3033 bp, Homo sapiens
  ENST00000486172
gggaaaacctgtccatgcctgaagcagcttgaccccagcaaacaccctgcctccatggagtgaactgcaaatctccaaaaaaaaaaaaaaaaaaaaaaaatctacttcctacccctcctgctccctggggagggacagaaggttcctaaaactgacagtttcgcctccatgatctttaaaagagcagaagctggctgtgaggctgcagtgctgcctcgattggggtagtgtggtctctgttgcggctgggctccaaggagagccacaattggctctgatgaggaaggagcctagaaatgaaagattgcaaagagggcttctgtacgccatggctgagactgtgtcgtttcttgcaaggtgaaacttggcagttctaccttgcaagtaaaaacctaaattaatttttttaaaagaaattaagtcagaaacaaggcttcggaaaaactgtgagtgttaggcataaactgattttggatgatctttaggtgagaaagggtggagttaccatcagaaacatgtttttatttatgcttttcgaatccccactggtgtgcgatgtgtgtgtgcgcgcgcgtgcatgtgcgtgtgtattggttagcgtgagagtatgcatcatctcaattctctaaccatttctttcttttttgcatcttttctgtgcacagttcatatagatcccctataaataaatatataggtccatccacaccttttcattttatttgtaaattgtttggtataagcggcagagcgtaatgaaacctggtgaagtttaaaagattagatttttttttatactgacacttcataacactgttcatatgtctccgagtgagatttatgaatatatgagcagtactgcaaaattatactgcaccagagacttcctgcaccacaggggtggcagtctaaagtgacacagcttcaagcatttttcacagacaagaagcaaaatttaacccccttaaggggaagtatgatttcaacagcttgaaatgagctcatttgtagatggtttttttttctctcatcttccataattttttggtgttaagattaaaacagattgcacagccaatataagggcacataagctgcccagagtacagtttggcccttaaagagaaattttcattcattgtctttatcagcactcctcaatcaggtaaatgaagataaacttgcccctaaattcctaaggctctcagcccaatttccagtattgtacttagcagacagggtgtggaattttcaaacggtaagtggcaaggaacatcaattaatccagtggagaagccctcatctctctggcaccaaagacagtgacattaggaaataattaatgtattgaatataaatggtgtaaaattaaccaataaaaaagagaatcagaagagcaaaagatggtctgtatgaattgaaacataggaaatgtctgtcgtggaagagttcaattagattcgaagtcctaactgtcttagattgtctgtcttggattggtccagtacccagtaccttgcaattttgtataaactaactaacgttcattaaactctatgctctcaaattctctttaaccattttgtttcctcctggaacagagtggggtactcaaacattgcctgctctctctctgccctataaatgctccatgatgtgttggctggagaacttttgtctcttttttcagcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaata

SEQ ID NO: 2926 - DNA, 2095 bp, Homo sapiens
  ENST00000473635
acctacccaatgtgaacctacccaatgtgaaccttcccaaagtaccaaatctaccagttaacatccctctaggcatcccacaaatgcctactttttcggcaccgtcatggatggctgctatatatgatgcggataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagtttgctaaaatgtggcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaata

SEQ ID NO: 2927 - DNA, 5190 bp, Homo sapiens
  ENST00000357948
tcagcagccgcagatggcatccggctgcgggctcggggctcgcaattgattctcccccttgcccacctcgagtccacggacgcacctctcccttcccctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaa

SEQ ID NO: 2928 - DNA, 4371 bp, Homo sapiens
  ENST00000474560
aatttaatagtatcagctgtctggtcaagtatattttccagctataactaagggttagcttgtttgtgaacagtttttcttttaattgttttgattggaaatctacttgaaatgcattacacaaccttcttgcctttttaaacagggtactgactataatcttttctcaatgactcaggatcaccattgtgaccatgtctttccccagtggctgcatagtgacccactcccctccagggcctcccaagatataggggaggcttgcccctgccctcgatagtcccaaaccccagcggttggtgagtctgcatgtctggtgttgcagttgggcagcctcctccctcaccgtcaggcataaggaaaaatgatagctctctcttatctgcacagttttttcaaacaatccccctcttccctatttctgctccatcaagggatggaaaccaaacttgttggaattggttgggagtgggagcttgaggactccattatgagaaaactacacatgttttgtgctgaggctttatcatttttattttgacgttggctcctctgaggcccccttttcttcttggttctagagtagattctaaaggtaggtaaggctgtggaatggtataatattatgggggggggggggaatcatagtaattcatgtttgtattacaatatatggctttcaaaacatttttacatacattattctagctgatgaccataacagtccgtggaggtaagtaggggagctgttagtaatcccattttatagatagcataactaaggcccagagaagtttttttttaactcttcttttacagaaaagtttaagtgatattcacaaattccaatttgtgggagatccagtaaaaatccatgcagtgtgactgaagagcttgaaaaaggaggagatggagaaaggatttgctcattcattcttgaatttgtccattcagcaaatatttactgggcccctactatatgctaggtaccattttgtatgctggggatgcaatagaaaacaggccaaacaaagttcctgggttcatggagcttatgttctagtgggataagagagaaaacaaatagtgtataatacaacatcagctattggtaagtgctattggaaaaagaagagtcaaaagggagcaaatcatggagtttcttaactacatgggtaagatgaaccacactgattttttaaaataccagagtttttaaaacttgaatgaagtgcccctttgaagacagtgaaacttcgtgaaaagagaaggagtggtgcaaatacgcatcattgtagattactgtttcttctaacattttgggttactgatagatctgccgcacttgactttgtaccttagctctaagatggttgcatgcgcccaggaaaaggccatattgccacaagcatcaccaggggagaaatagaaacaataataagtttctcaagtcccccaggtagagatccccatccctactgagaatgccctttgatgcacagttgccaaacggagagaaggagagaggtgcctgcttagaactgatagctatcacttacatctcattggagaacctctattgttttgtatcataaaactgcaacaattataggaccatcatggaacctgctcaatccattcgctgaaaattgtttgaaagtgtaacacttgactactgtggctttgggttgtcctcattgtttttcaaattaataccttgtcattgtttcagcaggtgttaagaaatgttactagcatcccaggggccaagcattggccctttgcatgataattgtttgctttgtatcaggaaaaaaaaatacagtcctactgtttctaaaccttcctcattttcaccctggaaattacacagaagtgttaactaacttcaatttacagtgcctgacagtcacgtctagtagagaaatgatactttgtgatctaaggtaaatcacagtaatgaaaactaatctttttagttattagcagacatatatatctactgtggaaatttgaggggtttgtggccactctcctaatgacctatattacagtgttttaataggtttctttggagataactttgattgtgacatctcaagcagagtgctttctgagtttctttttttttttacttccctacaataagtcatttcctaactgcaggatgaaccaccagcttacctttccagaaaatctgatttatttaaaaatcaaatcctctcctccttcccctgccttttgtttcttctcttcttcttcttctttttaatccttggactttaaggctgcactggaagcaaagacaaatggtttagtgtctcctctgagtgaactaattaattagcaaatactatatccactcaggttaagctatacacacacacacacacacacacacacacacacacacacacacaatgagacttgggtaggaagaggtatagattgaaacacaattttttttacttagtactttctcaatattttaaaagaggaaaaaggaatgggaagttccatcacccgtctgataatatattaaggacagtggaaaacagtatgtttggatattctttaatgcaggtttcaatccaaggcaaagtcagagaacatctatgggttatgcagtaaagatttatccattagataaatttgccaggaaaaaatttatcatagaaaaactatttataaaatcctacaatctcaatgcccttcttagccaggcttgatttctggaaagaggaagcagttctaatatcaattcctaccagcccaggctgtggacagcaatcccatgcctacaaagctgatccagcagaagcatctcagggtgtgtgagggcaagtagagggtacaagtgaatggtaaacaaggaagagtggctgtctgaaaattcgttttcatgttttcctgtttctttacagaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaag

SEQ ID NO: 2929 - DNA, 4591 bp, Homo sapiens
  ENST00000283269
ctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagggaaaaagagagaaatgtatgagcatcctgtcttctgcttggcctcccaagtgatggatttaaccattcaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaaca

SEQ ID NO: 2930 - DNA, 570 bp, Homo sapiens
  ENST00000466621
aaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaat

SEQ ID NO: 2931 - DNA, 427 bp, Homo sapiens
  ENST00000469292
tttgtaaaagtgtttaagtgtctacacacattagaagcatcgaaagccttgagtaaggaacaatgaacttggtaatatttttaagagcttcagatctctctctatcaaagaactggagtcaggatcttataaatatttctgggactaaggaaataaacggggtccgcaggccaggctttatttataaattaagttgtctaaaaattactgacggatgcagtgccatcacctcccaaacatgctaatatttgtctttctgtgttcttagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttacc

SEQ ID NO: 2932 - DNA, 288 bp, Homo sapiens
  ENST00000462768
ggtttttttcccaagccatcttagagagatctttcgtgacatttttccttagtataattgaatctgagacacttaaatgaccagctgtgggaaatgaggcttctttgaatgccaagtggctgagaacagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttacc

SEQ ID NO: 2933 - DNA, 669 bp, Homo sapiens
  ENST00000478408
ctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagaggtaaaaaaaaaaaaaaaaatacagatttttttttccctcttcattgatcatgtagaagaaaacttcacaaattccttccatctaccctagtctgctagtttcagaaatacactctaacatttgtggattaagccatggatgagtgttcagtatctgtttgtcaagtagatttctaaggcatgtgctgatgagaatgtcagtcacttggaagtgattcttggctggagttggggtggccatatagttctctaagctaaatgaagtttgacgaccttatttattaggctggtgtctcgaacagatctgtgtttgccagaatgaaagtcattttcacatttgaagtgcattttatcactttgaacatctggacagcaagagaggcctttcttgcatcaaacaacttccaggatgtataatgttagatcaccctgctacccaatccccagccagcaggttctgaatttc

SEQ ID NO: 2934 - DNA, 2048 bp, Homo sapiens
  ENST00000478570
tactaaatgatgtttatttcactatatcccatgtgctctgactctgagacttcaaggtttgaagggggctaaacatgaaatacaagttcccctggaattcagactggttgaatccaagcagtttcactggccaagaaaacctttatgttttggccgggcacagtggttcacgcctgtaatgccagcactttggaaggctgaggcgggcggatctcctgaggtaaggagtttgagaccatcctggccagcaaggtgaaactctgtctctactaaaaatacaaaaatcagcccggcgtggtggcgggtgcctgtaatcccagctactcaggaggctgaggcaggaggatcacttgaacccaggaggcagaggttgcagtgagctgagatcgcaccactgccctccagcctgggcaacagaataaatgagactccgtctccaaaaaaaacaagaaaaagaaaagaaagaaagaaaacctcctttatgttttaaatattactgttttcccaaaggaaaaaagtttgtaatttttggaacataatgacattgtcaaactcatgaactcagctctaaaaagaaggcaacataagccagggttcagattcttcttgagctgggtaaaaatacaacactttcagtttaagagaaactaaaaacaaagaaaacaattaagtacattgtttcagtttaactgataaaatttcaattgtaacaaccagtagcacaaactatcacaacccattcaataatctactcctaacacccttttaagaattattattcctgactaatggcccaggcatatccaatttttcttttctatctcctccctggacaacttgaagcagacatttgaatctgcattttcaaaatgagcgttccaacatacgcgagcctgcaatgaaaaattacgctgtagcatttaataactaatctaaaaaacaaatgtaacagcaatcaatattaaacttctgttaatcttcccacttcaggtagcataattacaatctagagagtggtatagtacatttatgctgtctttaaagaacatgtgtacaaaatgtcactaaatttgatatgggctgtcatagacttaatatagcttcatatgcaaatttgaagctggagcactgcttttttctaatatatattataataatggtgataataataaaatggctttatggtttgctcactactaattacatggcacttaacatttgcatgaattttttttaaaaaactgataactattctcaatttcttatccactagttctaatggccataaaagtagcctgccactttcgctgaattttaacacaaactcttgtactacagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagag

SEQ ID NO: 2935 - DNA, 610 bp, Homo sapiens
  ENST00000463002
acacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaaggtaagtataggtggctggacaggttctgcacaccctccccaccatacacagactcagggaagggtagatggctgctctttcaattggctgtagtttgaaactaattggagaaggggattgcttgtcaaagtcagctggagtagtggctgtcaacgtctaacttccattcacctgccctccatctgtcccaaacccaaaataatctggctgccaattttttcatggttgttggctttaagaggaaaagatccctgt

SEQ ID NO: 2936 - DNA, 933 bp, Homo sapiens
  ENST00000491424
taatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagagaatcaaaaggatgcagaaaatgtaggccggttaatcactcctgccaaaaagcttgaagatacaatacgtcttgctgaactagtcattgaagttcttcagcaaaatgaggagcaccacgcagaggggaaagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaa

SEQ ID NO: 2937 - DNA, 719 bp, Homo sapiens
  ENST00000468271
acgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacagtcaacaaatgcatgtgtaccttagtgggctgccaccaaatacagaccctgaagggagcaaaactccctccccacctgaaccagaagctaaaaaagataccaaaaaggaatccaaaaaaagaaaagattccaaaacccaggcaaatcaagagctgaaaaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctg

SEQ ID NO: 2938 - DNA, 535 bp, Homo sapiens
  ENST00000478434
aaagaaagcatcttgaagagaagggagtgcaaatgctgctgataggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccaccct

SEQ ID NO: 2939 - DNA, 637 bp, Homo sapiens
  ENST00000542833
caagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttctggactgaaggacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacg

SEQ ID NO: 2940 - DNA, 778 bp, Homo sapiens
  ENST00000490424
tttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctggcaagtatattctttggtctacagcaatttaaacataacattttttttcatttaaatatttctctacctttatgtcagaagctcttttctccattacagaatccctttaacaattataaatgtgttcccgatttcctgggttgagatagttttacttaccaaagaaacaagactgagcgggaggaagttatcagtagaaacagatccaattccccagcctccctatcttagcttcccccttttcagctgctacatgagaaatattcccaagagggtaatcgagtttggcacctgcttgtggagaacttgtaaaaattgcctcagtagcttagagtttaagatgcccttccctccccatcccagatctggtaatcctatctcattacatgaatgtattctctttgtgtattttcttaaaggttaaaatga

SEQ ID NO: 2941 - DNA, 2669 bp, Homo sapiens
  ENST00000490353
atgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacggtaatcaggagaaacagaagagaacaactgcctcacagtgccatttgatgtcccgtctttgtgccatgtcaaatcatctccaggggtacaagatttgtgcttgaagagtcacagtacccaatctctgtttactgaataatttcactatagtctgtgtatttccctggtttacactcatccttttgggtgtttttcctagagcattccatggtttcttttctgtttagtaaatccgtgccagcttgcaaagtgacgtgaatgagaaagatggaattagtaatgttgttgaatgtgaacactcaagacaaaagaaagaaaacattttcccccttagctggctttgtcttctcaatgaccggaatgaaatgtcaagtgaacgtgttaattcttaatggggataccaatgaaagcttcaggggaagagaacatttaacagaggctctcacttttctctgaattttatttggatagacattagcattttattacagccttggaaaagatgagatgacaattattgacaaggttcccaggacacaaataaataaaatgaataaattgtttatttgataaatttcaattatctacaaggtgtaaaacactatagatgcgaatgattaaaaaataaagagcaaagaccctgttttcaggatgcagcatacttacagggaaataaatcatgtacatttagtagtgaatataaaaaagtaaagattccattctggggaaaactgcagattgcttctgttgagaaaaccaaagaatggtcctggagaagatggctcttgaaaatggcccttgaatttggctagaaagcatttgcaagtacagaaagggtggcaagggcattccagcaaaacgaagtggtatccgccaacacctatagtctcagaagtgctgtactgtgtagggaacgtaggttctaaaaaggaggtataaaaggaggaagagaaaagaaagaaatctataaatataggctgagtcaaggtataaaagagctttgcggacgaaactaagaggaagagagcttaaagaaacaagtacatttagcagggataggataaacactggggacagagagctcctgaaccagtgtgacccggctccagtggtgtcctgtttctgtgcctctccattcatgtgaacatgtgtgtgcatgtgtgtgcgtgtgtgtgtgtgtgtgtgtgtgtgaaaaacttttatgacaaaattgaaatgacattgttagtcatacattttgacattgaattttacaatgtttatgcatctaagcttgcagccgttatacttggataatctatgtctttgtttctgctataaaaccatgttttctcttggtgtgg

SEQ ID NO: 2942 - DNA, 1804 bp, Homo sapiens
  ENST00000613879
aatagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagtttgctaaaatgtggcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcct

SEQ ID NO: 2943 - DNA, 5455 bp, Homo sapiens
  ENST00000612439
ggctgcatcgacagcttgcaacactcggcatcttttctggaggcgcctccttcagcagccgcagatggcatccggctgcgggctcggggctcgcaattgattctcccccttgcccacctcgagtccacggacgcacctctcccttcccctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacagtcaacaaatgcatgtgtaccttagtgggctgccaccaaatacagaccctgaagggagcaaaactccctccccacctgaaccagaagctaaaaaagataccaaaaaggaatccaaaaaaagaaaagattccaaaacccaggcaaatcaagagctgaaaaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaatata

SEQ ID NO: 2944 - DNA, 2238 bp, Homo sapiens
  ENST00000462699
attacactagactcacagaatatgccaaaatagaaggcccagcagaaaaggaaacagagaccatgaaccaggcatctcctgctagaaagctggaagagattcttcatctggcagagctctgcatagaagtcttacagcagaatgaagagcatcatgcagagggaagagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcat

SEQ ID NO: 2945 - DNA, 4308 bp, Homo sapiens
  ENST00000412584
ttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaacaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagtttggtagtcaatggcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaa

SEQ ID NO: 2946 - DNA, 4073 bp, Homo sapiens
  ENST00000449022
ggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttctggtaaagatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagagggaagagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgcc

SEQ ID NO: 2947 - DNA, 2826 bp, Homo sapiens
  ENST00000397721
tgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaacaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaa

SEQ ID NO: 2948 - DNA, 572 bp, Homo sapiens
  ENST00000476131
aaaggtgctttgtagatttttattcattcgaacatttaccttggaattctgaatcctcataaataatacattcagagaagtggagaaaggcaatacgttttgagtcaacacaaaatgacagcaagataatgtattcttttgtcataaaatattgagaaaatgggaagacaataactggtattaattaccgacagggtttaaatatgccaattaagtagaaaataaggagatgtcttggtgaatattgaagatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggtt

SEQ ID NO: 2949 - DNA, 6045 bp, Homo sapiens
  ENST00000334010
attcaattccacgtgttgcttgttgtaggcgccacaggttccccacctgcgtccgggcgctcgggcggctccgcctctgccggcgggctctggggaaccgctgggtcggcgcgcccggggctggcggagcaattcctgaggcgcccaagctcacccccaacgctaactccgcctattcagtcccggcggctccccctctcccccctcccaatcctcctcccggctcctgcccgcccctttcgccctggtggtaggaaacactcctgaatctaactcgacgtgtccggaaagccctggccagttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttctgaatttacagatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcataactacttctgtatttattagacttatatagagcaaatgcagtaaaagaggtttgcagtgtttcaaacatcccaactatctgactctgtgtttttgtttcttgagttttttgtttgttttgtttgtaatattttgtttttaatcaaatgagtaaaagatagtaacactgactgttctttgtacctaataggcacatacattgttaaaagaattactatgacagcatatttccatagcagaggaaatatatatttcatatattattagttaatattagtaatcaatgttaactaataattagtaatgttagtaatattaactagtaattcacattattagtggttctctcaaaatattttcttgctagggtttgagagataattgtattatgttgcgtaagttctctatgaattatttttgtgatatttcccaaaacatattggcagattgtgctactgcatttattaataagtaatttttaaatgaaggcagttaatgcagaataagtggaggtatccctgcatttatgaaaacgtttattctgaaactttagaaatgaaacaacttggacctccagattcgttctcccatggtgtaataagtggtcgttaggtacctagactagccttaaaaatctatttaatctacagttactatttagcattgttttggctcattttctgggccctagggctaagataacaaacaaggaaatttcttccttcttccgggattaaagactaactctaccaactcactatctttgaaaggcagtttgggaatgttctccctccttttcttctctattcacacaccaaatactattttctccaaaccctcaaatgtccagtcatgctatcccaaactctccaatggcaccatccccaagcttgctgttccacgacacattgctctgtacttagtaattacccacccttcttttcctttcaataaaatgtccatttccttgat

SEQ ID NO: 2950 - DNA, 6066 bp, Homo sapiens
  ENST00000615869
attcaattccacgtgttgcttgttgtaggcgccacaggttccccacctgcgtccgggcgctcgggcggctccgcctctgccggcgggctctggggaaccgctgggtcggcgcgcccggggctggcggagcaattcctgaggcgcccaagctcacccccaacgctaactccgcctattcagtcccggcggctccccctctcccccctcccaatcctcctcccggctcctgcccgcccctttcgccctggtggtaggaaacactcctgaatctaactcgacgtgtccggaaagccctggccagttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttctgaatttacagatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaaggcccagcagaaaaggaaacagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcataactacttctgtatttattagacttatatagagcaaatgcagtaaaagaggtttgcagtgtttcaaacatcccaactatctgactctgtgtttttgtttcttgagttttttgtttgttttgtttgtaatattttgtttttaatcaaatgagtaaaagatagtaacactgactgttctttgtacctaataggcacatacattgttaaaagaattactatgacagcatatttccatagcagaggaaatatatatttcatatattattagttaatattagtaatcaatgttaactaataattagtaatgttagtaatattaactagtaattcacattattagtggttctctcaaaatattttcttgctagggtttgagagataattgtattatgttgcgtaagttctctatgaattatttttgtgatatttcccaaaacatattggcagattgtgctactgcatttattaataagtaatttttaaatgaaggcagttaatgcagaataagtggaggtatccctgcatttatgaaaacgtttattctgaaactttagaaatgaaacaacttggacctccagattcgttctcccatggtgtaataagtggtcgttaggtacctagactagccttaaaaatctatttaatctacagttactatttagcattgttttggctcattttctgggccctagggctaagataacaaacaaggaaatttcttccttcttccgggattaaagactaactctaccaactcactatctttgaaaggcagtttgggaatgttctccctccttttcttctctattcacacaccaaatactattttctccaaaccctcaaatgtccagtcatgctatcccaaactctccaatggcaccatccccaagcttgctgttccacgacacattgctctgtacttagtaattacccacccttcttttcctttcaataaaatgtccatttccttgat

SEQ ID NO: 2951 - DNA, 6065 bp, Homo sapiens
  ENST00000313070
attcaattccacgtgttgcttgttgtaggcgccacaggttccccacctgcgtccgggcgctcgggcggctccgcctctgccggcgggctctggggaaccgctgggtcggcgcgcccggggctggcggagcaattcctgaggcgcccaagctcacccccaacgctaactccgcctattcagtcccggcggctccccctctcccccctcccaatcctcctcccggctcctgcccgcccctttcgccctggtggtaggaaacactcctgaatctaactcgacgtgtccggaaagccctggccagttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttctggtaaagatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaaggcccagcagaaaaggaaacagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcataactacttctgtatttattagacttatatagagcaaatgcagtaaaagaggtttgcagtgtttcaaacatcccaactatctgactctgtgtttttgtttcttgagttttttgtttgttttgtttgtaatattttgtttttaatcaaatgagtaaaagatagtaacactgactgttctttgtacctaataggcacatacattgttaaaagaattactatgacagcatatttccatagcagaggaaatatatatttcatatattattagttaatattagtaatcaatgttaactaataattagtaatgttagtaatattaactagtaattcacattattagtggttctctcaaaatattttcttgctagggtttgagagataattgtattatgttgcgtaagttctctatgaattatttttgtgatatttcccaaaacatattggcagattgtgctactgcatttattaataagtaatttttaaatgaaggcagttaatgcagaataagtggaggtatccctgcatttatgaaaacgtttattctgaaactttagaaatgaaacaacttggacctccagattcgttctcccatggtgtaataagtggtcgttaggtacctagactagccttaaaaatctatttaatctacagttactatttagcattgttttggctcattttctgggccctagggctaagataacaaacaaggaaatttcttccttcttccgggattaaagactaactctaccaactcactatctttgaaaggcagtttgggaatgttctccctccttttcttctctattcacacaccaaatactattttctccaaaccctcaaatgtccagtcatgctatcccaaactctccaatggcaccatccccaagcttgctgttccacgacacattgctctgtacttagtaattacccacccttcttttcctttcaataaaatgtccatttccttgatac

SEQ ID NO: 2952 - DNA, 5392 bp, Homo sapiens
  ENST00000469032
aattaatcgagagctaattaaaatttaaatatatatgttgggaaatatttccccatgggcacaaaactaagtaatcgagctgtccagtatcttggtaggtagtgtgacaatatcagaatttatggtcaatggattataaaatgttttgtcagcatgggatcctgaaaaaaatctgcctcctacaaaagattcttagaatacctcgaaccacagaatgcccttcctttccttcttaaaaagatgtcactaaatctatatccattataacactggacacattctgttctttaaaaacaaaaataatgttaatttttcacatatttagtgttcatttagtatacacattttatatatttaatgtaattcatatatactactttggtataacatattatagcaatagttgctactatctaaaaaggtgaatgcttcccaaatacgggtatgagtgtgtttacatctggatgtgtctttgtgaatgacgtatatataagtgcagtggagagttggagagctttatggagtttctaatacccaatagaaaataaaacaattcaaaattattcaaaaattctgttctgtaaggatttatttgtcatctgttttctgcttctgtttgtggtattctatgctctaaaagggtgaaataaatatttattttcttattggagagattccagatgtgcaaaaactgtcagacaccatccctcccacatcttgatacacatatgaacgtatttgcaataaaaaagtgacagtattctagaaacatagctaaaaccactatttctctgtttgactattctatattatcctgataaactctagcaatggacacattacagaattgaaaatttgcattgaaagttttaaaaatgctagtttttaaaattttactgcatatatacaagtagttgataactcaaacagctttattttgaagttcatctccttcatgcaataaattattcctcaaatagctagaataatggcattctgtctttcagctgaaactatttgattcaaataatgatgggaagctggaattaactgagatggccaggtgagtttaggaaccatgaaaaatattgtaagtggatccttttcaaaaaatgtaatatattaatataatgtttttctctcaaaaggttactaccagtgcaggagaattttcttcttaaattccagggaatcaaaatgtgtgggaaagagttcaataaggcttttgagctgtatgatcaggtaaaagtttgttactttttcctttcttttttattgaagtaagaacacaacataagatcctcttaacaaaatttaagtataaaatacagtactgcaaactatagagacaatcttgacagcagatctttagaatttatccatcttatataattgagactttatgcccattgatgagtaactcgtcatttctccttcccccagccctggcaataacattctactttatgagtgtgactattttagatacctcatacaagtggcatcatgcagaatttgtcttgtgctgagattgattgatcatatgcagttctatttttaattttttgagggctctccatactgtttttcatagtggatgcaccatttttgcattcccaccaatgtatacaagagttccaattttcttcattctcactaacacttgtcttttatctttttgataatagccattctaataggtgtgaggagatatcttattgttaatttttatttctctgattagtgatgttaagcattttttcattacctgttggccatttatataccttctttggataagtgtctactcaagtcattaacccattttttaaattgaattattcattttttgctattgagttacaggagttctttataaattttggaaattaaccctttttgggatgtggtttacaaatattttctcccattctgtaggctgcttttgcactctgttgattgtttcctttgctgtgcagctttttagtttgatgtagtctcgcttgtctatttttgcttgtgttgtccttgcttatggtttcatatccacaatatcattgctaagaacaatgtcataaaggtttcccttatgtttgtttgcttctaggagttttacagttttagatcttatatttaagtttttaatctatcttgaatttattttttatatggtgtaagctaagggtccaatttcattattttgcatgtgtctgtatagtttacctaacaccatttgttgaaaaaagctatccttgtcccattttgtgtttttggcacccttatcaaagatcagttgactataacatgtgaaactgagagctcattagtctatgtttcgatttttgtttcagagctatactgttttaatcattgtagctttgtaatatattttgaaatcaagaagtgtgatgtctccaggtttattcttttttctcaagatggtttttggctatttgggatcttttgtggttacatatgaattttagggtttttttatttctataaatattgccattgggattttggaagtgattacactgaatctgtagatgtgtttgagtaatatagacattttaacaatattaagccttccaattcataaacacaggacgtctttccatttgtttgtgtctctgttaacttctttcatcagtattttatgatttttagtgtataagtttttcctctcagttaactttattcctaagtattttattcttttggtgctcttgtaaatgggattttctaatttccatttcagatagtttatcatcataactaatttctgattgttaattttgcatcctacaactttatggaatttgtttattaattccaacagtttttgtgaggtctttagggttttctctctataaaaataatatctgcaaacagggataatttaacttctctctttccaatttggatgccttaaaattttgttcttatctataatttgattcttcagaatttggaaaaaacgattatgaaaattacacaaataactccttcttttcataggaaaggtaatacggtatgcccaaattacacaaactcctgattcgaatcccacactatcatttacctgctttgagactttgaacaagataccaaactcatgtgagcctcaatttcttcatttgtaaacaagagataataataacaccactttgcaggattgaatgaggattaagctaggtgaaaatatccagcaaaataaaggttatttgtgatgtcactaggtcacatcctttgcttctaatttgtttactcctggacctgtgagctctagcagaactctgccacaccctggtgtgacatagagccacataccttcctcagccctcagtttcctcacttgtcctagaagatattattaacattaagtgaattacatgtgtaagtactttgaaaagttcaagatcttttacaaatgtaaggtgttgaatgagaagtaactaataccttgcatattttacagctttggagcagctaaaaacttgggtggcctgacataacagattatctgccaagtatgcagttgggagactttctaaggattccaattatttccattttacttcatttcccactactgtagatggagttggttgtatactattttatttctcctcccccaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatgtcatactctgtgtaatctctgattaaatttaatatactgcatatcctggtgtctagtttgcatacttcctggattttctttctatgtagaactgttcatttccaccaagggtatctgctgcctctgaaaatatttttttctagctataacaactctattttttactacataattaaattttaatgtaaaattcatagcatcctgattattgaatgttatatcatcaatacttttgtgtattctgtggattctatatttcatattgagatcagcattcaaaatagttctatttctatctgcaaatagtttcaaatgagtttaaaaaaataacatctgaaaagaaatgctaatgtaatcatttatcttatctagcaagaagattctaaaacattctttaacatacatctaagtcagtttcacatatttgtagctagaatatcctatactggttatagttgatatgtaacagttggtgattttagatttctttgattgtgaaacagggagctatgagagatgtgtccatgtgaaatttacagttactgcctaggagttaatgatcgttctgggtcagcttgaatgtccccattctataaattcaacacttattttctgaattcataaaaataaccaaaaaatgtgagctataatgtttccctcaagaacaaacagaaacgagatttgccaaaaactaaaattcaacaaatgatgttgagtgggagattggctttgcctttagcgtgtaaatggaagcactgccattagactgaatttaactactaagaataaataaagaagaaaataaccttaa

SEQ ID NO: 2953 - DNA, 2533 bp, Homo sapiens
  ENST00000265431
agggagagaactctggaggaacgctgagctgagcagcaccgaggacagcgcccggcagcgcccgcgcccaggtctccctccgcagccctgactcgcgcacacgctgagcttttgctcactccccctcgcgcggacacagacacacgcatattcacacacccagacacacaccccgctgtacaatggcagaatcccacctgcagtcatccctcatcacagcctcacagtttttcgagatctggctccatttcgacgctgacggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatgtcatactctgtgtaatctctgattaaatttaatatactgcatatcctggtgtctagtttgcatacttcctggattttctttctatgtagaactgttcatttccaccaagggtatctgctgcctctgaaaatatttttttctagctataacaactctattttttactacataattaaattttaatgtaaaattcatagcatcctgattattgaatgttatatcatcaatacttttgtgtattctgtggattctatatttcatattgagatcagcattcaaaatagttctatttctatctgcaaatagtttcaaatgagtttaaaaaaataacatctgaaaagaaatgctaatgtaatcatttatcttatctagcaagaagattctaaaacattctttaacatacatctaagtcagtttcacatatttgtagctagaatatcctatactggttatagttgatatgtaacagttggtgattttagatttctttgattgtgaaacagggagctatgagagatgtgtccatgtgaaatttacagttactgcctaggagttaatgatcgttctgggtcagcttgaatgtccccattctataaattcaacacttattttctgaattcataaaaataaccaaaaaatgtgagctataatgtttccctcaagaacaaacagaaacgagatttgccaaaaactaaaattcaacaaatgatgttgagtgggagattggctttgcctttagcgtgtaaatggaagcactgccattagactgaatttaactactaagaataaataaagaagaaaataaccttaa

SEQ ID NO: 2954 - DNA, 1490 bp, Homo sapiens
  ENST00000518457
aagaaacagatctgcagattatggatctcttactctatcaccaattattattgttgtgatgttgatgtagttggggagatgagaaaacatcttgtcctcactaagggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatg

SEQ ID NO: 2955 - DNA, 801 bp, Homo sapiens
  ENST00000497376
atacggtatgcccaaattacacaaactcctgattcgaatcccacactatcatttacctgctttgagactttgaacaagataccaaactcatgtgagcctcaatttcttcatttgtaaacaagagataataataacaccactttgcaggattgaatgaggattaagctaggtgaaaatatccagcaaaataaaggttatttgtgatgtcactaggtcacatcctttgcttctaatttgtttactcctggacctgtgagctctagcagaactctgccacaccctggtgtgacatagagccacataccttcctcagccctcagtttcctcacttgtcctagaagatattattaacattaagtgaattacatgtgtaagtactttgaaaagttcaagatcttttacaaatgtaaggtgttgaatgagaagtaactaataccttgcatattttacagctttggagcagctaaaaacttgggtggcctgacataacagattatctgccaagtatgcagttgggagactttctaaggattccaattatttccattttacttcatttcccactactgtagatggagttggttgtatactattttatttctcctcccccaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagt

SEQ ID NO: 2956 - DNA, 591 bp, Homo sapiens
  ENST00000522070
agctggaattaactgagatggccaggttactaccagtgcaggagaattttcttcttaaattccagggaatcaaaatgtgtgggaaagagttcaataaggcttttgagctgtatgatcaggtaaaagtttgttactttttcctttcttttttattgaagtaagaacacaacataagatcctcttaacaaaatttaagtataaaatacagtactgcaaactatagagacaatcttgacagcagatctttagaatttatccatcttatataattgagactttatgcccattgatgagtaactcgtcatttctccttcccccagccctggcaataacattctactttatgagtgtgactattttagatacctcatacaagtggcatcatgcagaatttgtcttgtgctgagattgattgatcatatgcagttctatttttaattttttgagggctctccatactgtttttcatagtggatgcaccatttttgcattcccaccaatgtatacaagagttccaattttcttcattctcactaacacttgtcttttatctttttgataatagccattctaataggtgtgaggagatat

SEQ ID NO: 2957 - DNA, 636 bp, Homo sapiens
  ENST00000523716
aaagcctgtttggtggtctcttcacatggacgcacatgaaatttggtgccgtgactcagatcaggggacctcccttgggagataaatcccctgtcctcctgctctttgctctgtgagaaagatccacctacgacctcaggtcctcagaccgaccagcccaagaaacatctcaccaatttcaaatctggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaat

SEQ ID NO: 2958 - DNA, 548 bp, Homo sapiens
  ENST00000520613
cacctacgacctcaggtcctcagaccgaccagcccaagaaacatctcaccaatttcaaatctgcggctgaagattgatgctgcctcattgcctcagaagccccatagaccatcacggacgccaagcttccggtaactctcacagtggagggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgat

SEQ ID NO: 2959 - DNA, 826 bp, Homo sapiens
  ENST00000482702
aactctggaggaacgctgagctgagcagcaccgaggacagcgcccggcagcgcccgcgcccaggtctccctccgcagccctgactcgcgcacacgctgagcttttgctcactccccctcgcgcggacacagacacacgcatattcacacacccagacacacaccccgctgtacaatggcagaatcccacctgcagtcatccctcatcacagcctcacagtttttcgagatctggctccatttcgacgctgacggaacggtaatggtaggagagagagagcagggattggggaatgctgcccccccaaagtttctgtggctgcgcttagcaccccaaccatcctcctttgtcctcagtggatctaaagtttgataccccaggaggggagcgcttcaccgtctgtacactttgctggttaatcaacgtccaggcaagagagagcctctcgggtcgccagaaagataactgtcttggaaagtgaacgggaaagacacttggaatgagatatctgacacctgggtgcctctttgtctttgcaggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggag

SEQ ID NO: 2960 - DNA, 534 bp, Homo sapiens
  ENST00000476853
caaaaccttaaacttttgtctttccaggaacggtaatggtaggagagagagagcagggattggggaatgctgcccccccaaagtttctgtggctgcgcttagcaccccaaccatcctcctttgtcctcagtggatctaaagtttgataccccaggaggggagcgcttcaccgtctgtacactttgctggttaatcaacgtccaggcaagagagagcctctcgggtcgccagaaagataactgtcttggaaagtgaacgggaaagacacttggaatgagatatctgacacctgggtgcctctttgtctttgcaggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgt

SEQ ID NO: 2961 - DNA, 695 bp, Homo sapiens
  ENST00000473670
gtttccatgccccttcccattctttgcccttttctgagcctcctgatcccattatccctcctttctattctttacttcttcccccttctgcctaatcttatcttcttatctccccgactggccgccaaactgtcaacctgaaagtttatattgtttccaccgtaatcccaaaaccttaaacttttgtctttccaggaacggtaatggtaggagagagagagcagggattggggaatgctgcccccccaaagtttctgtggctgcgcttagcaccccaaccatcctcctttgtcctcagtggatctaaagtttgataccccaggaggggagcgcttcaccgtctgtacactttgctggttaatcaacgtccaggcaagagagagcctctcgggtcgccagaaagataactgtcttggaaagtgaacgggaaagacacttggaatgagatatctgacacctgggtgcctctttgtctttgcaggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagaggtaaggaatttatgcatttttctgatttaattttaataaatgagtttcaattttgaagttgt

SEQ ID NO: 2962 - DNA, 561 bp, Homo sapiens
  ENST00000514406
ctgtttggtggtctcttcacatggacgcacatgaaatttggtgccgtgactcagatcaggggacctcccttgggagataaatcccctgtcctcctgctctttgctctgtgagaaagatccacctacgacctcaggtcctcagaccgaccagcccaagaaacatctcaccaatttcaaatctggagcttgctacaagtgccagaaatctgaccaccaggccaaggaatgcctgcagcccaggattcctcctaagccatgtcccatctgtgcgggaccacactggaaatcggactgttcaactcacctggcagccactcccagagcccctggaactctggcccaaggctctctgactgactccttcttggcttagcggctgaagattgatgctgcctcattgcctcagaagccccatagaccatcacggacgccaagcttccggtaactctcacagtggagggaagtggttacctggaaggaaaggagctgcagaacttgatccaggagctccagcaggcgcgaaagaaggctggattggagttatcacctgaaatgaaaact

SEQ ID NO: 2963 - DNA, 1466 bp, Homo sapiens
  ENST00000302628
caaccccagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaatgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaacttacccaa

SEQ ID NO: 2964 - DNA, 704 bp, Homo sapiens
  ENST00000562305
tggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggaaatgaatattcaacagctcaccaactacagaaagagcgtcatgtccttggcagaggcagggaagctctaccgcaag

SEQ ID NO: 2965 - DNA, 472 bp, Homo sapiens
  ENST00000490520
gctagaaaactttttccaagagctggagaaggcaaggaaaggctctggcatgctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgag

SEQ ID NO: 2966 - DNA, 424 bp, Homo sapiens
  ENST00000467817
aacgcacatgaaaagcaccacaatgaaaggctacccaaagcttgcacccactgccaccttcctgccatgactggttaaggcagaagggacacattattttgtcattacacgatctgaacacccccttttgcacagagtaatggagaggctagactcttagacatccctggaatgggtcgggacagcaggggcccaggctttagagctctgggttgactctgctcccatccccaggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaa

SEQ ID NO: 2967 - DNA, 1373 bp, Homo sapiens
  ENST00000349553
gcacaaccccagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaatgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaacttaccc

SEQ ID NO: 2968 - DNA, 1373 bp, Homo sapiens; identical to SEQ ID NO: 2967
  ENST00000635154

SEQ ID NO: 2969 - DNA, 1466 bp, Homo sapiens; identical to SEQ ID NO: 2963
  ENST00000635371

SEQ ID NO: 2970 - DNA, 704 bp, Homo sapiens; identical to SEQ ID NO: 2964
  ENST00000635576

SEQ ID NO: 2971 - DNA, 472 bp, Homo sapiens; identical to SEQ ID NO: 2965
  ENST00000634959

SEQ ID NO: 2972 - DNA, 424 bp, Homo sapiens; identical to SEQ ID NO: 2966
  ENST00000634226

SEQ ID NO: 2973 - DNA, 5155 bp, Homo sapiens
  ENST00000392370
acacagcctatgatctctctctgttcaggctgcttcttgctcttgtctcacaataagaaaggagtgctgctttcctggggtatgctatttgagaaagaaagtaacctaacactaactgcaggcggggtcagagtgatgtaacaggaagctctgatgtttcccttctgctgctgatcacttacaatctgacaacacttacaatctactcagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagactggagacaattgtgcatatcgtctaataataaaaacccatactagcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcaccaagtgtggaattggagaaaagcacaatcaacttttctgagctggtgtaagccagttccagcacaccattgcatgaattcacaaacaaatggctgtaaaactaaacatacatgttgggcatgattctacccttattgccccaagagacctagctaaggtctataaacatgaagggaaaattagcttttagttttaaaactctttatcccatcttgattggggcagttgactttttttttgcccagagtgccgtagtcctttttgtaactaccctctcaaatggacaataccagaagtgaattatccctgctggctttcttttctctatgaaaagcaactgagtacaattgttatgatctactcatttgctgacacatcagttatatcttgtggcatatccattgtggaaactggatgaacaggatgtataatatgcaatcctacttctatatcattaggaaaacatcttagttgatgctacaaaacaccttgtcaacctcttcctgtcttaccaaacagtgggagggaattcctagctgtaaatataaattttgtcccttccatttctactgtataaacaaattagcaatcattttatataaagaaaatcaatgaaggatttcttattttcttggaattttgtaaaaagaaattgtgaaaaatgagcttgtaaatactccattattttattttatagtctcaaatcaaatacatacaacctatgtaatttttaaagcaaatatataatgcaacaatgtgtgtatgttaatatctgatactgtatctgggctgattttttaaataaaatagagtctggaatgctatatttggtaaatattttaaagacaaccagatgccagcatcagaagtctgtttgagaactaagagaacagaaacatctatcataagatatatttattttaaaaacacaaggtcactattttattgaatatatttgttttgataactcataccttaataataggtgtgtttgacatatttcttttttcattttgacaatgaactcacattctaatccagaaattttaaacaactactgtgataaataccaatctgctacttttatagattttaccccattaaaatattactttactgacttttactatgtgaagatatatagctttggaaatgtcccaggctattcaagaaatataaaaaactagaaggatactatatataccatatacaatgctttaatattttaatagagctactgtatataatacaaattagggaaatacttgaatatatcattgagaaaaaattattgtcagatcttactgaattattgtcagactttattaaataaagatagaagaaaaccttgctaatgaattaaagtgaaatttgcatgggattcagtttctctaatgttattttccgctgaaatctctaaagaacaagaatgacttcaattagtaaaagtcaattttgggaaaagtcatgggtatctgttttttaagtgtgtcaatctgattaaaatggatgaaacaaattactcatcataagttgtttcttaagctgtcaatatgtcaatagatggtgagttcagaacttatttcaaattgctaagacaaattatctaaattcgtaagaattaacatatagaatggtctggtcagtacatttataatttatctatgcatgaaaaagtattgttttgtttgaaacatgaatttcatagcaagctgccatagaaaggaacgcaggctgttctagaccttcaactgcctaaattatacaaaaattcattttaataaactcaattattagctatttattattcaaagacccatatttaaatcctttgctgaccatgttgacatatatcagccttcttctagacaaactgtcaactctcaaccatcttgacagtagaagtgacagtaaaaaatgttgaatgatcagagattatattaaaataaacatgtaattttcaagtatttttgttgtgcttttataatattaattctagatcagatttattttatagccagggtttgtctgttgtagagtcttgaggcgtagcagtcattcatgattaatcactgttagttttgtacccatatatttttagaatagttttaaatgttagatttctcaaaagctaaatgctacttaatatctttgtatcatactcataaagcaaagtaaatctgacactttttttaaagcaaacttctttgctgtcaaaaaaataaatttggggaaatttctagcttttaaaatgtagatctgcattttactgtgattacttgtgaaagtcatattttaattttctaaattctaatttgtcattttatttcctaaagttaatttccaatgcatttattcataaaatattcattctggaatgcagtgtttgtttaaatgtaatccaatgtatatagaattagtggtggctgtagtgctgtatttattgcttataattttttttaaatgtgaacttacttttaattttctcttggttttaatctgctagtagaaaccactagttatctgtaaaaatatattcaagatattctgatcaattataacaatttatgttatgcctagagtatatctctattttttgattgtatgaaaatattaaagttatgagttaaagtttattttcactgatatttactacagtgccaaataatctaatttataaacataattcttacagtaatcaatgggatacttctcaaaattaacaaatctcttaacaaaatatatcttttgccctctttaaagtcttcagtaaaccagtaaatgaattcaataaaccaa

SEQ ID NO: 2974 - DNA, 5223 bp, Homo sapiens
  ENST00000409998
acacagcctatgatctctctctgttcaggctgcttcttgctcttgtctcacaataagaaaggagtgctgctttcctggggtatgctatttgagaaagaaagtaacctaacactaactgcaggcggggtcagagtgatgtaacaggaagctctgatgtttcccttctgctgctgatcacttacaatctgacaacacttacaatctactcagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactggggtcctacgatgatacaccaaccacttgtgctaccatctgtcaaaactttggatggccctactttcaggtcttgacccctgaatttaagaaattcttaaagacaatgtcaaatatgatccaagagaaaatgtgatttgagactggagacaattgtgcatatcgtctaataataaaaacccatactagcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcaccaagtgtggaattggagaaaagcacaatcaacttttctgagctggtgtaagccagttccagcacaccattgcatgaattcacaaacaaatggctgtaaaactaaacatacatgttgggcatgattctacccttattgccccaagagacctagctaaggtctataaacatgaagggaaaattagcttttagttttaaaactctttatcccatcttgattggggcagttgactttttttttgcccagagtgccgtagtcctttttgtaactaccctctcaaatggacaataccagaagtgaattatccctgctggctttcttttctctatgaaaagcaactgagtacaattgttatgatctactcatttgctgacacatcagttatatcttgtggcatatccattgtggaaactggatgaacaggatgtataatatgcaatcctacttctatatcattaggaaaacatcttagttgatgctacaaaacaccttgtcaacctcttcctgtcttaccaaacagtgggagggaattcctagctgtaaatataaattttgtcccttccatttctactgtataaacaaattagcaatcattttatataaagaaaatcaatgaaggatttcttattttcttggaattttgtaaaaagaaattgtgaaaaatgagcttgtaaatactccattattttattttatagtctcaaatcaaatacatacaacctatgtaatttttaaagcaaatatataatgcaacaatgtgtgtatgttaatatctgatactgtatctgggctgattttttaaataaaatagagtctggaatgctatatttggtaaatattttaaagacaaccagatgccagcatcagaagtctgtttgagaactaagagaacagaaacatctatcataagatatatttattttaaaaacacaaggtcactattttattgaatatatttgttttgataactcataccttaataataggtgtgtttgacatatttcttttttcattttgacaatgaactcacattctaatccagaaattttaaacaactactgtgataaataccaatctgctacttttatagattttaccccattaaaatattactttactgacttttactatgtgaagatatatagctttggaaatgtcccaggctattcaagaaatataaaaaactagaaggatactatatataccatatacaatgctttaatattttaatagagctactgtatataatacaaattagggaaatacttgaatatatcattgagaaaaaattattgtcagatcttactgaattattgtcagactttattaaataaagatagaagaaaaccttgctaatgaattaaagtgaaatttgcatgggattcagtttctctaatgttattttccgctgaaatctctaaagaacaagaatgacttcaattagtaaaagtcaattttgggaaaagtcatgggtatctgttttttaagtgtgtcaatctgattaaaatggatgaaacaaattactcatcataagttgtttcttaagctgtcaatatgtcaatagatggtgagttcagaacttatttcaaattgctaagacaaattatctaaattcgtaagaattaacatatagaatggtctggtcagtacatttataatttatctatgcatgaaaaagtattgttttgtttgaaacatgaatttcatagcaagctgccatagaaaggaacgcaggctgttctagaccttcaactgcctaaattatacaaaaattcattttaataaactcaattattagctatttattattcaaagacccatatttaaatcctttgctgaccatgttgacatatatcagccttcttctagacaaactgtcaactctcaaccatcttgacagtagaagtgacagtaaaaaatgttgaatgatcagagattatattaaaataaacatgtaattttcaagtatttttgttgtgcttttataatattaattctagatcagatttattttatagccagggtttgtctgttgtagagtcttgaggcgtagcagtcattcatgattaatcactgttagttttgtacccatatatttttagaatagttttaaatgttagatttctcaaaagctaaatgctacttaatatctttgtatcatactcataaagcaaagtaaatctgacactttttttaaagcaaacttctttgctgtcaaaaaaataaatttggggaaatttctagcttttaaaatgtagatctgcattttactgtgattacttgtgaaagtcatattttaattttctaaattctaatttgtcattttatttcctaaagttaatttccaatgcatttattcataaaatattcattctggaatgcagtgtttgtttaaatgtaatccaatgtatatagaattagtggtggctgtagtgctgtatttattgcttataattttttttaaatgtgaacttacttttaattttctcttggttttaatctgctagtagaaaccactagttatctgtaaaaatatattcaagatattctgatcaattataacaatttatgttatgcctagagtatatctctattttttgattgtatgaaaatattaaagttatgagttaaagtttattttcactgatatttactacagtgccaaataatctaatttataaacataattcttacagtaatcaatgggatacttctcaaaattaacaaatctcttaacaaaatatatcttttgccctctttaaagtcttcagtaaaccagtaaatgaattcaataaaccaa

SEQ ID NO: 2975 - DNA, 1984 bp, Homo sapiens
  ENST00000410068
agaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagactggagacaattgtgcattttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcacc

SEQ ID NO: 2976 - DNA, 642 bp, Homo sapiens
  ENST00000447403
agaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactggggtcctacgatgatacaccaaccacttgtgctaccatctgtcaaaactttggatggccctactttcaggtcttgacccctgaatttaagaaattcttaaagacaatgtcaaatatgatccaagagaaaatgtgatttgagactggagacaattgtgcattttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgt

SEQ ID NO: 2977 - DNA, 591 bp, Homo sapiens
  ENST00000410102
agaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagactggagacaattgtgcatcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgtattttctggttctcttgcctttttttatgattcttgttacagcagaattagaagagagtcctgaggactcaattcagttgggagttactag

SEQ ID NO: 2978 - DNA, 588 bp, Homo sapiens
  ENST00000474212
agaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtgcttggtgtaaacttttggatggtaaagccttatctgccttttcgactgggacaatgggtcctacgatgatacaccaaccacttgtgctaccatctgtcaaaactttggatggccctactttcaggtcttgacccctgaatttaagaaattcttaaagacaatgtcaaatatgatccaagagaaaatgtgatttgagactggagacaattgtgcatatcgtctaataataaaaacccatactagcctatagaaaacaatatttgaaagattgctaccactaaaaagaaaactactacaacttgacaagactgctgcaaacttcaatttgtcaaccacaacttgacaaggttgctataaaacaagattgctac

SEQ ID NO: 2979 - DNA, 573 bp, Homo sapiens
  ENST00000485973
cagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagactggagacaattgtgcatgtaagtattgggaaattaaattttctcatggtaaaatttaataaaaactaaaatattaacttattaattactgaattaaataaactgactcattgttttctgtctataacaacactacttttattaaaattaatacaatgattcatggtattttggttatatttttctcaagatcgtctaataataaaaacccatactagcctatagaaaacaatatttgaaagattgctaccactaaaaagaaaactactacaacttgacaagact

SEQ ID NO: 2980 - DNA, 569 bp, Homo sapiens
  ENST00000461244
agaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactggccacctcagatacttttatagatcaaggagtaaggaacagaattcaaaagacagacatggacatcagaaacaaatggccaagagttttcccagcagacagacagcatgagttgcagggcgttaggaaaaactatacagtgcttggtgtaaacttttggatggtaaagccttatctgccttttcgactgggacaatgggtcctacgatgatacaccaaccacttgtgctaccatctgtcaaaactttggatggccctactttcaggtcttgacccctgaatttaagaaattcttaaagacaatgtcaaatatgatccaagagaaaatgtgatttgagactggagacaattgtgcat

SEQ ID NO: 2981 - DNA, 729 bp, Homo sapiens
  ENST00000479784
tcactctttcccaccttgcttgtgggtaaatctcttctgcggaatctcagaaagtaaagttccatcctgagaatatttcacaaagaatttccttaagagctggactggggtcctacgatgatacaccaaccacttgtgctaccatctgtcaaaactttggatggccctactttcaggcggagtcttgctctgtcgcccaggctggagtgcagtggcgcgaccttggctcactgcaagctccacctcccgtgttcacgccattctcctgcctcagcctcccgagtagctgggactacaggcacccaccaccacgcccagctaattgtttgtatttttagtagagatggggtttctccgtgttagccaggatggtctcaatctcccgacctcgtgatccacccgccttggcctcccaaaatgctgggattacaggcgtgagccactgtacctggctgcttatagtattttgaagtgttgcttaatgaatcaattttatgaatgatcatcttatcatctctttaaaattttatagcacactgtcctatttctcagagttcaaattaggtatactcccatgtgtatgagagacacaattaatgacttgtaggtcataattaaagattcaaaagattcatttttgttaatagaatgtttacaaatacttattctcattttgctgtataatgagcagtgtctccaattaaagtaattaaaattcaaccaaatgag

SEQ ID NO: 2982 - DNA, 1652 bp, Homo sapiens
  ENST00000369783
gcctgtccctgccttaagtgcctactggatcccgggagcctgggctggggcctgggcactgcttcctccttggcccctcaggcccttggaagcagagagagaacctcttgcagatcccaggctcgtccccagcacagcagacaccaggaaggtggccagagcctcactgagccgaaccgacggccgcccacccacccaggctggagccatggataaattccgcatgctcttccagcacttccagtcaagctcggagtcggtgatgaatggcatctgcctgctgctggctgcggtcaccgtcaagctgtactcctcctttgacttcaactgtccctgcctggtgcactacaatgcactctacggcctgggcctgctgctgacgcccccgctcgccctgtttctctgcggcctcctcgccaaccggcagtctgtggtgatggtcgaggagtggcgccggcccgcagggcaccggaggaaggacccaggcatcatcaggtacatgtgctcctctgtgctgcagagggcgctggccgcccccctggtctggatcctgctggccctccttgacgggaagtgcttcgtgtgtgccttcagcagctctgtggaccctgagaagtttctggactttgccaacatgacccccagccaggtacagctcttcctggccaaggttccctgcaaggaggatgagctggtcagggatagccctgctcggaaggcagtgtctcgctacctgcggtgcctgtcacaggccatcggctggagcgtcaccctgctgctgatcatcgcggccttcctggcccgctgcctgaggccctgcttcgaccagacagtcttcctgcagcgcagatactggagcaactacgtggacctggagcagaagctcttcgacgagacctgctgtgagcatgcgcgggacttcgcgcaccgctgcgtgctgcacttctttgccagcatgcggagtgagctgcaggcgcgggggctgcgccggggcaatgcaggcaggagactcgagctccccgcagtgcctgagcccccagaaggcctggatagtggaagtgggaaggcccacctgcgcgcaatctccagccgggagcaggtggaccgcctcctaagcacgtggtactccagcaagccgccgctggacctggctgcatcccccgggctctgcgggggtggccttagccaccgcgcccctaccttggcactgggcacgaggctgtcacaacacaccgacgtgtagggtcctggccaggcttgaagcggcagtgttcgcaggtgaaatgccgcgctgacaaagttctggagtctttccaggccgtggggaccccacggcaggcaccctaagtcttgttagcctcctttttaaagtagcccaatctctgcctagtttctgggtgtggcctccagcgcgcttcacaaactttaatgtggactcggttcaccgagggccttgttaaatacaggttcagacagtgtagccaggaccgagtctgagattctgcattttaaacaagctcctggaggctgatgtgcttttggtcagtgaaccaaactttgagtagcaagaatctaagtaaatctgccatgggttctgggttctagatgtcaattctaaataataataatgaccttagtctgctgcctcgata

SEQ ID NO: 2983 - DNA, 9243 bp, Homo sapiens
  ENST00000329008
gacaaggacagggaggcacgcgcccagatcgcgctccgagtcgacgagggggctcgtgcaggtcccggcgcgcgcgtggggagcggcccgggggcgccgagggagccggcggcagcgaggatgccggcacggggacgcggctgcctgctgggggtgtgagcgagaggctgagcgctgcccgctcggcgcatccattccgcaccgccccctccctgcgggcctcggaggaagccccccgcgctgtgcggaggcgcctcggctgccgggctgcggagccccggcccagcaagagggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaaaaaatacaaaaattagccaagcatggtgtcgggcacctgtaatcctagctactctggaggctgaggagggagaatcacttgaaccctggaggcggaggctgcagtgagctgagatcgcgccactgcactccagcctgggcaacagagcaaaacttcatctcaaaaaataattttaaaaaagaaacattattcaccagctaagacttttcaatttaaattatttaaagtgacagcaacatagaggagaatttgggctgcctcttaccgacccagtctccatgataatttgagtgtcacaactgttcagcttcacttcatacttgctttgactaagtcactcgggattgtcctcaattttttggccctgccataaataggtgtatgttagtccgttttgcattgctataaaggaataccttaacactgggtaatttataaagaaaagaggtttatttggctcgcagttctgcaggctgtttgagcaaggtatcaacatctgcttggcttctggtgagacctcagaaagctttgacccatggtggaaggtgaagggggagcaggcacgtcacacagcaagaacaggagcaagagagaggagaagaggtgccagtctccttttcttaacaacccgcaattgcatgaactaataaagtaagaattcactcattactacagggagggcaccgagtcattcatgaggaatctgtccctatgacccaaatatctcccagcaggccccacctccagcactggagatcaacatgaaatttggggggaacaaatatccagcctctatgattggtttggagcaatgagatcaattacaccaacaagccaagcatttctcttagtatcctatggtcattgctaatgcatatggtcattttgacagctgtggtttctccttcatattcatttgggactcttcatagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttga

SEQ ID NO: 2984 - DNA, 9459 bp, Homo sapiens
  ENST00000395275
aagagaataaaagctggctccccgagcccgctggggaagctcgctggggtgctatccgcttgagtttgtgtttttttctttcctgcttcttaataaagcttactgcttactctgggtccgcgccacctttaaagctcacggccgcggtctgcgtcttcgttcttgaagtcagcaagaccgcaagcccaccgggaggagcagacgactccggacgcgccatctttaagagctgtaacactcaccgcgaggtccgtggttttattcttaaagtcggcgagaccaacaacccagcagaaggaataaattccgcacacagagtctcagtgccttcgctgacgttcctttgatgagcttctaactctctctgagaacatcgccctggacccccgatgcggctgccagagcaacccggagaggggaagcccgagaatgagaaaaagggggacggaggagccctcggagggggagaggagccgccgaggagccaggcccccgacttccccacctgggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaaaaaatacaaaaattagccaagcatggtgtcgggcacctgtaatcctagctactctggaggctgaggagggagaatcacttgaaccctggaggcggaggctgcagtgagctgagatcgcgccactgcactccagcctgggcaacagagcaaaacttcatctcaaaaaataattttaaaaaagaaacattattcaccagctaagacttttcaatttaaattatttaaagtgacagcaacatagaggagaatttgggctgcctcttaccgacccagtctccatgataatttgagtgtcacaactgttcagcttcacttcatacttgctttgactaagtcactcgggattgtcctcaattttttggccctgccataaataggtgtatgttagtccgttttgcattgctataaaggaataccttaacactgggtaatttataaagaaaagaggtttatttggctcgcagttctgcaggctgtttgagcaaggtatcaacatctgcttggcttctggtgagacctcagaaagctttgacccatggtggaaggtgaagggggagcaggcacgtcacacagcaagaacaggagcaagagagaggagaagaggtgccagtctccttttcttaacaacccgcaattgcatgaactaataaagtaagaattcactcattactacagggagggcaccgagtcattcatgaggaatctgtccctatgacccaaatatctcccagcaggccccacctccagcactggagatcaacatgaaatttggggggaacaaatatccagcctctatgattggtttggagcaatgagatcaattacaccaacaagccaagcatttctcttagtatcctatggtcattgctaatgcatatggtcattttgacagctgtggtttctccttcatattcatttgggactcttcatagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttga

SEQ ID NO: 2985 - DNA, 9189 bp, Homo sapiens
  ENST00000395276
tcccccgagatcagcaggagcttactgcttactctgggtccgcgccacctttaaagctcacggccgcggtctgcgtcttcgttcttgaagtcagcaagaccgcaagcccaccgggaggagcagacgactccggacgcgccatctttaagagctgtaacactcaccgcgaggtccgtggttttattcttaaagtcggcgagaccaacaacccagcagaaggaataaattccgcacacagggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaaaaaatacaaaaattagccaagcatggtgtcgggcacctgtaatcctagctactctggaggctgaggagggagaatcacttgaaccctggaggcggaggctgcagtgagctgagatcgcgccactgcactccagcctgggcaacagagcaaaacttcatctcaaaaaataattttaaaaaagaaacattattcaccagctaagacttttcaatttaaattatttaaagtgacagcaacatagaggagaatttgggctgcctcttaccgacccagtctccatgataatttgagtgtcacaactgttcagcttcacttcatacttgctttgactaagtcactcgggattgtcctcaattttttggccctgccataaataggtgtatgttagtccgttttgcattgctataaaggaataccttaacactgggtaatttataaagaaaagaggtttatttggctcgcagttctgcaggctgtttgagcaaggtatcaacatctgcttggcttctggtgagacctcagaaagctttgacccatggtggaaggtgaagggggagcaggcacgtcacacagcaagaacaggagcaagagagaggagaagaggtgccagtctccttttcttaacaacccgcaattgcatgaactaataaagtaagaattcactcattactacagggagggcaccgagtcattcatgaggaatctgtccctatgacccaaatatctcccagcaggccccacctccagcactggagatcaacatgaaatttggggggaacaaatatccagcctctatgattggtttggagcaatgagatcaattacaccaacaagccaagcatttctcttagtatcctatggtcattgctaatgcatatggtcattttgacagctgtggtttctccttcatattcatttgggactcttcatagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttga

SEQ ID NO: 2986 - DNA, 777 bp, Homo sapiens
  ENST00000431984
ggtccatcattctgaggagctgcagtgccctgctccttcctgatggcttagagattctccttaactcccagccatggatcttggagaatttcccccgagatcagcaggagggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtag

SEQ ID NO: 2987 - DNA, 550 bp, Homo sapiens
  ENST00000446128
gtgcctccctggacgtctccaggggcggtcacgcggaatgctggtccccgcagtttcggccattggcccctccacttcggcgccccgccttccccctgggctcaggtgtaatcgtggatctagggtgtgggcacctgggatgaagtagtgaaggcggcgggcgctaggggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcag

SEQ ID NO: 2988 - DNA, 8571 bp, Homo sapiens
  ENST00000405452
cagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaaaaaatacaaaaattagccaagcatggtgtcgggcacctgtaatcctagctactctggaggctgaggagggagaatcacttgaaccctggaggcggaggctgcagtgagctgagatcgcgccactgcactccagcctgggcaacagagcaaaacttcatctcaaaaaataattttaaaaaagaaacattattcaccagctaagacttttcaatttaaattatttaaagtgacagcaacatagaggagaatttgggctgcctcttaccgacccagtctccatgataatttgagtgtcacaactgttcagcttcacttcatacttgctttgactaagtcactcgggattgtcctcaattttttggccctgccataaataggtgtatgttagtccgttttgcattgctataaaggaataccttaacactgggtaatttataaagaaaagaggtttatttggctcgcagttctgcaggctgtttgagcaaggtatcaacatctgcttggcttctggtgagacctcagaaagctttgacccatggtggaaggtgaagggggagcaggcacgtcacacagcaagaacaggagcaagagagaggagaagaggtgccagtctccttttcttaacaacccgcaattgcatgaactaataaagtaagaattcactcattactacagggagggcaccgagtcattcatgaggaatctgtccctatgacccaaatatctcccagcaggccccacctccagcactggagatcaacatgaaatttggggggaacaaatatccagcctctatgattggtttggagcaatgagatcaattacaccaacaagccaagcatttctcttagtatcctatggtcattgctaatgcatatggtcattttgacagctgtggtttctccttcatattcatttgggactcttcatagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttg

SEQ ID NO: 2989 - DNA, 957 bp, Homo sapiens
  ENST00000587486
gtataaaagtgcaaggcgggcggcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaag

SEQ ID NO: 2990 - DNA, 1903 bp, Homo sapiens
  ENST00000316448
ccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctc

SEQ ID NO: 2991 - DNA, 781 bp, Homo sapiens
  ENST00000590325
tactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaa

SEQ ID NO: 2992 - DNA, 776 bp, Homo sapiens
  ENST00000588454
aaagggcccgcgcgttgccgccccctcggcccgccatgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggc

SEQ ID NO: 2993 - DNA, 913 bp, Homo sapiens
  ENST00000586760
cggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttct

SEQ ID NO: 2994 - DNA, 667 bp, Homo sapiens
  ENST00000586803
tagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcag

SEQ ID NO: 2995 - DNA, 394 bp, Homo sapiens
  ENST00000586967
aggaggaagatgtccccggccaggccaaggacgagctgtagagaggcctgcctccagggctggactgaggcctgagcgctcctgccgcagagctggccgcgccaaataatgtctctctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctc

SEQ ID NO: 2996 - DNA, 2271 bp, Homo sapiens
  ENST00000252939
gcatcctccgcatccacatccgcatcgtcgtcctccccgaccgcgtcctgcagcagctgccagtggagccgcctgacaaggactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcaggctgcccaccgcacggatgatcgccttcgccatggcgctactgggctgcgtgctgatcatgtacaaggccatctggtacgaccagttcacctgccccgacggcttcctgctgcggcacaagatctgcacgccgctgaccctggagatgtactacacggagatggaccccgagcgccaccgcagcatcctggcggccatcggggcctacccgctgagccgcaagcacggcacggagacgccggcggcctggggggacggctaccgcgcagccaaggaggagcgcaaggggcccacccaggctggggcggcggcggcggccaccgaaccccccgggaagccgtcggccaaggcggagaaggaggcggcgcggaaggcggccgggagcgcggcgcccccgcccgcgcagtgacgtctccagccccgcagcccggcccgggcgtcctccgccagctcctgtgaccagcgcgtctcccgatgctctccgccgtgttcgtgtccccaggcgccctcgctgcagccccgcccccgtgggtctctgactctgtcgcttttctctaagtaaagatttcacgtccaccggaggcttccatctctcctgcgcgtcctctgccgggctggcctttctcccgccccccaccccgccagttgtgagtgaggccggcattgtgctccccccagggacccccgaaggacccaggagagaccccgtggggggcagctcccaggaagccgtggtgcgcccaggcggagcacgcgcatcctcgcgctgcgtggtccgggccttgtccaagccccaccgggatgtgccttaatggcggggctccggcccacccaggggagcctcgggtccatccctatccgctgcccagccccttgtcctgctggttccccgaccccccgcccccatctacctggtgctgggcctgggccccgggcgttccccctctgacaggagtgtctgcctcccgggggacccctggttctgggcggcacccatgagcagctcctgcctcctagatgtgtggcccacaggcataaatgaccaagtgaagaaaggagtgaatgggggcgtctgagtggggagtggggcctgatgaggggtgagctctggttcctgggggctggggtctcccgtgtccctggagccagatgaaagatggtgaggctgaaacgccaggggagcctggagctgccatgagtctcccccagcatccccaccccagccccagcatccccaccccagccccagcatccccaccccagccccagccaactcccggcactgaacactacagggaatggacttccggcagatctcacccaccacctgcaccaccccagccagcagcagctctgcagccccgcccaccccagccagcagcagctctgcagccccgcccaccccagccagcagcagctctgcagccccgcccaccccagccaattgcagcactgcagccccgcccaccccagccaattgcagcactgcagccccgcccaccccagccagcagcggctctgcagccccgcccaccccagcccccgaccattggtggatggaagccccccaccattggctcccaggcttgctggctaggtgcgggtctaggcagcttcccagctcagtgggactggcctgctttggaacagcggcagtgcccaggaagcctgtgaactgggcctgccagggaagccatggtgagctggaagccagccaggtggggtcagggaaggcagggccatgcacaccacacccttcactgctgggcttctaagggcattggccagatgaacaagcacacgcagaactgaattggccctgatggcctgcaagggaggggggcccggggcctggggcgtcagctgggatatatgggggcagggagtctctgcatggccgatgtttgaattaaaatacagctttcccctgta

SEQ ID NO: 2997 - DNA, 555 bp, Homo sapiens
  ENST00000467433
ccggggcgcacaggagggctcagccccaccgaccctgacccggcccctcccgcagcacaagatctgcacgccgctgaccctggagatgtactacacggagatggaccccgagcgccaccgcagcatcctggcggccatcggggcctacccgctgagccgcaagcacggcacggagacgccggcggcctggggggacggctaccgcgcagccaaggaggagcgcaaggggcccacccaggctggggcggcggcggcggccaccgaaccccccgggaagccgtcggccaaggcggagaaggaggcggcgcggaaggcggccgggagcgcggcgcccccgcccgcgcagtgacgtctccagccccgcagcccggcccggggtaggtgcgcgccgcggggctccggccggctctgcccagcgtcctccgccagctcctgtgaccagcgcgtctcccgatgctctccgccgtgttcgtgtccccaggcgccctcgctgcagccccgcccccgtgggtctctgactctgtcgcttttctctaagtaaagatttcacgtcca

SEQ ID NO: 2998 - DNA, 655 bp, Homo sapiens
  ENST00000467611
acaacgcgcgacctcctgctccatgcccctccagggccctgagttctgaactggaggctgatcttcggtgtcctgaagccatggctccattacaaactgtccgcagtgtccccaaccgcagaagcgggagggcctgggcccggggcgcacaggagggctcagccccaccgaccctgacccggcccctcccgcagcacaagatctgcacgccgctgaccctggagatgtactacacggagatggaccccgagcgccaccgcagcatcctggcggccatcggggcctacccgctgagccgcaagcacggcacggagacgccggcggcctggggggacggctaccgcgcagccaaggaggagcgcaaggggcccacccaggctggggcggcggcggcggccaccgaaccccccgggaagccgtcggccaaggcggagaaggaggcggcgcggaaggcggccgggagcgcggcgcccccgcccgcgcagtgacgtctccagccccgcagcccggcccgggcgtcctccgccagctcctgtgaccagcgcgtctcccgatgctctccgccgtgttcgtgtccccaggcgccctcgctgcagccccgcccccgtgggtctctgactctgtcgcttttctctaagtaaagatttcacgtcca

SEQ ID NO: 2999 - DNA, 825 bp, Homo sapiens
  ENST00000368558
cccgcccggccgcgaagcgtctggaaccgcatcctccgcatccacatccgcatcgtcgtcctccccgaccgcgtcctgcagcagctgccagtggagccgcctgactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcaggctgcccaccgcacggatgatcgccttcgccatggcgctactgggctgcgtgctgatcatgtacaaggccatctggtacgaccagttcacctgccccgacggcttcctgctgcggggccctgagttctgaactggaggctgatcttcggtgtcctgaagccatggctccattacaaactgtccgcagtgtccccaaccgcagaagcgggagggcctgggcccggggcgcacaggagggctcagccccaccgaccctgacccggcccctcccgcagcacaagatctgcacgccgctgaccctggagatgtactacacggagatggaccccgagcgccaccgcagcatcctggcggccatcggggcctacccgctgagccgcaagcacggcacggagacgccggcggcctggggggacggctaccgcgcagccaaggaggagcgcaaggggcccacccaggctggg

SEQ ID NO: 3000 - DNA, 783 bp, Homo sapiens
  ENST00000368555
cccgaccgcgtcctgcagcagctgccagtggagccgcctgacaaggactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcagggtaaccacacccaccccacccactgtggggactcaggacaggaggagaaggtggaaggcagctgggggtgcctgggttccgtccaggccagtctggggtccccttgctctcagggaggagagggtggcagtgagtcatcccgcccagagctggccccaccggctgccctgcacccaccaggccccctcccgaggctgcaggtgcagactgaccaaacagtggcgctcctgagatgtttttctttctgggaagtgcccgcgagtgctgcttgcttgtttgcccagtgggtcattgtctcatcttcagtgacttacgggctttctatgtaatacttcctttctgcagtatatctggcaaatatcttctctcatcctcttgtttaaatctgtcaatgttactaatgatagctttagtcatttttagtggactgtttccaaagccttccattctccagtagacagatctgctagggctcccc

SEQ ID NO: 3001 - DNA, 2612 bp, Homo sapiens
  ENST00000009105
acagacctgtaggagctggagtgggagctcaagcaggattcttcccgagtccctgggtaagacaaccctgcttcttttcttggctttagagggtctccttgcttaatgggaagcgtgcagcacctagtgagtggatttgaagagccactttgtaagcaacttgggcatttatttcagccccagttccagtcttccctgactcttttggcatcaaggcatcctcagaagcttcaactctggaggcaatgggtcgaaaggaagaagatgactgcagttcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcaccacccactactacctggtcatgcagcttgtttctggtggggagctctttgaccggatcctggagcggggtgtctacacagagaaggatgccagtctggtgatccagcaggtcttgtcggcagtgaaatacctacatgagaatggcatcgtccacagagacttaaagcccgaaaacctgctttaccttacccctgaagagaactctaagatcatgatcactgactttggtctgtccaagatggaacagaatggcatcatgtccactgcctgtgggaccccaggctacgtggctccagaagtgctggcccagaaaccctacagcaaggctgtggattgctggtccatcggcgtcatcacctacatattgctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaaggccttgagtcatccctggattgacggaaacacagccctccaccgggacatctacccatcagtcagcctccagatccagaagaactttgctaagagcaagtggaggcaagccttcaacgcagcagctgtggtgcaccacatgaggaagctacacatgaacctgcacagcccgggcgtccgcccagaggtggagaacaggccgcctgaaactcaagcctcagaaacctctagacccagctcccctgagatcaccatcaccgaggcacctgtcctggaccacagtgtagcactccctgccctgacccaattaccctgccagcatggccgccggcccactgcccctggtggcaggtccctcaactgcctggtcaatggctccctccacatcagcagcagcctggtgcccatgcatcaggggtccctggccgccgggccctgtggctgctgctccagctgcctgaacattgggagcaaaggaaagtcctcctactgctctgagcccacactcctcaaaaaggccaacaaaaaacagaacttcaagtcggaggtcatggtaccagttaaagccagtggcagctcccactgccgggcagggcagactggagtctgtctcattatgtgattcctggagcctgtgcctatgtcactgcaattttcaggagacatattcaactcctctgctcttccaaacctggtgtctatccggcagagggaggaaggcagagcaagtggagcagggcttagcaggagcagtttctggccagaagcaccagcctgctgccagcggggcagcccctcataggaggcccaggagggagccccaaggcgtagaagccttgttgaagctgtgagcaggagaagcggtgcccaccagcttccaggtctccctgacctgcctgctctatgccccacaccctacgtgccgtggctctgtgcagtgtacgtagatagctctcgcctgggtctgtgctgtttgtcgtgaaaagcttaatgggctggccaggctgtgtcaccttctccaagcaaagccatatggagcatctacccagactcccactctgcacacactcactcccacctctcaagcctccaacctcttggccagattgggctcattaatgtcgttgcctgcccatctgcatgaatgacaggcagctccccatggtggtctgcctgtgagctcttcaagttctaatccttaactccaggattagctcccaagtgcgctgagacccagccagcacacttctggcccttctccctgcctcaatctaaaagcagtgccacaccctccaaagtggaatagaaagaagttcatgagtaagggctgcaaggaattcttatcctggccacatgtcctccgtgcacacacccaatggagttaaccttggaagttgactattttaatgtctgccaggagttctaatcctgcctctgttcccttttctctccttgaaagtccagcacaccattcttgtccttccccagtttcctcgccctccacccctccagcttcatgctcagtgttgtgcttaataaaatggacatatttttctct

SEQ ID NO: 3002 - DNA, 808 bp, Homo sapiens
  ENST00000423146
gagctggagtgggagctcaagcaggattcttcccgagtccctggcatcctcagaagcttcaactctggaggcaatgggtcgaaaggaagaagatgactgcagttcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcaccacccactactacctggtcatgcagcttgtttctggtggggagctctttgaccggatcctggagcggggtgtctacacagagaaggatgccagtctggtgatccagcaggtcttgtcggcagtgaaatacctacatgagaatggcatcgtccacagagacttaaagcccgaaaacctgctttaccttacccctgaagagaactctaagatcatgatcactgactttggtctgtccaagatggaacagaatggcatcatgtccactgcctgtgggaccccaggctacgtgggctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaagg

SEQ ID NO: 3003 - DNA, 2440 bp, Homo sapiens
  ENST00000361322
gagctggagtgggagctcaagcaggattcttcccgagtccctggcatcctcagaagcttcaactctggaggcaatgggtcgaaaggaagaagatgactgcagttcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcaccacccactactacctggtcatgcagcttgtttctggtggggagctctttgaccggatcctggagcggggtgtctacacagagaaggatgccagtctggtgatccagcaggtcttgtcggcagtgaaatacctacatgagaatggcatcgtccacagagacttaaagcccgaaaacctgctttaccttacccctgaagagaactctaagatcatgatcactgactttggtctgtccaagatggaacagaatggcatcatgtccactgcctgtgggaccccaggctacgtggctccagaagtgctggcccagaaaccctacagcaaggctgtggattgctggtccatcggcgtcatcacctacatattgctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaaggccttgagtcatccctggattgacggaaacacagccctccaccgggacatctacccatcagtcagcctccagatccagaagaactttgctaagagcaagtggaggcaagccttcaacgcagcagctgtggtgcaccacatgaggaagctacacatgaacctgcacagcccgggcgtccgcccagaggtggagaacaggccgcctgaaactcaagcctcagaaacctctagacccagctcccctgagatcaccatcaccgaggcacctgtcctggaccacagtgtagcactccctgccctgacccaattaccctgccagcatggccgccggcccactgcccctggtggcaggtccctcaactgcctggtcaatggctccctccacatcagcagcagcctggtgcccatgcatcaggggtccctggccgccgggccctgtggctgctgctccagctgcctgaacattgggagcaaaggaaagtcctcctactgctctgagcccacactcctcaaaaaggccaacaaaaaacagaacttcaagtcggaggtcatggtaccagttaaagccagtggcagctcccactgccgggcagggcagactggagtctgtctcattatgtgattcctggagcctgtgcctatgtcactgcaattttcaggagacatattcaactcctctgctcttccaaacctggtgtctatccggcagagggaggaaggcagagcaagtggagcagggcttagcaggagcagtttctggccagaagcaccagcctgctgccagcggggcagcccctcataggaggcccaggagggagccccaaggcgtagaagccttgttgaagctgtgagcaggagaagcggtgcccaccagcttccaggtctccctgacctgcctgctctatgccccacaccctacgtgccgtggctctgtgcagtgtacgtagatagctctcgcctgggtctgtgctgtttgtcgtgaaaagcttaatgggctggccaggctgtgtcaccttctccaagcaaagccatatggagcatctacccagactcccactctgcacacactcactcccacctctcaagcctccaacctcttggccagattgggctcattaatgtcgttgcctgcccatctgcatgaatgacaggcagctccccatggtggtctgcctgtgagctcttcaagttctaatccttaactccaggattagctcccaagtgcgctgagacccagccagcacacttctggcccttctccctgcctcaatctaaaagcagtgccacaccctccaaagtggaatagaaagaagttcatgagtaagggctgcaaggaattcttatcctggccacatgtcctccgtgcacacacccaatggagttaaccttggaagttgactattttaatgtctgccaggagttctaatcctgcctctgttcccttttctctccttgaaagtccagcacaccattcttgtccttccccagtttcctcgccctccacccctccagcttcatgctcagtgttgtgcttaataaaatggacatatttttctct

SEQ ID NO: 3004 - DNA, 573 bp, Homo sapiens
  ENST00000494990
agctcccaccccaaagccctctcctcttgccaccagccctgactctgcccttggtctgctgcagctccagaagtgctggcccagaaaccctacagcaaggctgtggattgctggtccatcggcgtcatcacctacatattgctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaaggccttgagtcatccctggattgacggaaacacagccctccaccgggacatctacccatcagtcagcctccagatccagaagaactttgctaagagcaagtggaggcaagccttcaacgcagcagctgtggtgcaccacatgaggaagctacacatgaacctgcacagcccgggcgtccgcccagaggtggagaacaggccgcctgaaactcaagcctcagaaacctctagacccagctcccctgagatcaccatcacc

SEQ ID NO: 3005 - DNA, 5322 bp, Homo sapiens
  ENST00000348628
tttccctgtaaaccttagaacccagctgttgccagggcaacggggcaatacctgtctctctagagatgaagttgccagggtaactgcatcctgtcattcgttcctggggaccatccggaatgcggcacccactggctgttaccatggcaactgcctttttgccccacttaatcccatcccgtctgctacaagggccccacagttggaggtgggggaggtgggaagagaaaagatcacttgtggacaaagtttgctctattccacctcctccaggccctccttgggtccatcaccccaggggtgctgggtccatcccacccccaggcccacacaggcttgcagtattgtgtgcggtatggtcagggcgtccgagagcaggtttcgcagtggaaggcaggcaggtgttggggaggcagttaccggggcaacgggaacagggcgttttggaggtggttgccatggggacctggatgctgacgaaggctcgcgaggctgtgagcagccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggatggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggtggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtaccctcgaccctcctgggtgttggttggagcagaactggtgaggatgtttgatccgagattttctgagctctccccaatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgtggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttctttttttttttcttttcttttttaaaaatatgtggctgtgaacttgaatgaacactgctcaaactttctgctattggggggggcgggtgggatgggaagaaggggcgtttgttttattcttggtgttttcagtgcaataaatagctacaaacttctgtgca

SEQ ID NO: 3006 - DNA, 1557 bp, Homo sapiens
  ENST00000351010
gatcgctgggccagctctgctccctgcagtctgccctccggctgcgtgtggatgctgctcgtcctcgccctgtgggccctggtgccctgcctggcgttgttaaccctctactttttctcctccacaggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggatggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttct

SEQ ID NO: 3007 - DNA, 1493 bp, Homo sapiens
  ENST00000398376
caggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggatggcaaatggcagatcgtccacttccacagatctggggcgccctccgtcctgccccactgagggaccaggctggggtcgc

SEQ ID NO: 3008 - DNA, 1565 bp, Homo sapiens
  ENST00000508662
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaaggtagggaggggccttcagtgtcgggaccccttagacttctggaaccagctctgagcagacctctttttcctgacagctcccacgtgccaacctcatttcttgctcatctacagagagcttcgctctggtgccttataaactgggcacactgggaggcatcattcccatggagggcgggggtggtactggaactactgctggtgtgtagataggttttcttattttatttatttttattttatttttttgagatgacgtctcgctctgtcgtccaggctggagtgcagtggcacgatctcggctcactgcaacctctgcctcccaggttcaagcgatcctcctgcctcagcctcccaagtagctgggatgacagatgcctgccaccacacctggctaattttttgtattttt

SEQ ID NO: 3009 - DNA, 557 bp, Homo sapiens
  ENST00000515758
atgtgcaattctctcctgaagtgagagggcccagcgggatctgcttgtagaggtgaagtcggccatttagtctggctagagtatagggcctgaggaacaggcctggaggagtctcggagaagcctcacatttaagaatcatggaaacggaggccagagagggcgagggatgtgcttgagtcactgcaacccaggcctcttcctctttccactgcaccccatggtcttcctggagaactcagaggccctggccagaagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtga

SEQ ID NO: 3010 - DNA, 540 bp, Homo sapiens
  ENST00000510347
aaaagatcacttgtggacaaagtttgctctattccacctcctccaggccctccttgggtccatcaccccaggggtgctgggtccatcccacccccaggcccacacaggcttgcagtattgtgtgcggtatggtcagggcgtccgagagcaggtttcgcagtggaaggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacct

SEQ ID NO: 3011 - DNA, 554 bp, Homo sapiens
  ENST00000507995
acagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagtgagagggcccagcgggatctgcttgtagaggtgaagtcggccatttagtctggctagagtatagggcctgaggaacaggcctggaggagtctcggagaagcctcacatttaagaatcatggaaacggaggccagagagggcgagggatgtgcttgagtcactgcaacccaggcctcttcctctttccactgcaccccatggtcttcctggagaactcagaggccctggccagaa

SEQ ID NO: 3012 - DNA, 3563 bp, Homo sapiens
  ENST00000351293
ggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaaggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 3013 - DNA, 3720 bp, Homo sapiens
  ENST00000322635
agtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagttggcaggcagagctccgcccccgcctcgcctgccgcgagcgccgccggcctggccgggcaagctgccaaaagcctattgaacaagaagtcggatggcggtgtcaagaaaaggaagtcgagttccagcgtgcacctaatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 3014 - DNA, 1618 bp, Homo sapiens
  ENST00000433289
cgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaa

SEQ ID NO: 3015 - DNA, 1820 bp, Homo sapiens
  ENST00000305762
atggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagaaaaggaagtcgagttccagcgtgcacctaatgccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaa

SEQ ID NO: 3016 - DNA, 1822 bp, Homo sapiens
  ENST00000372765
gtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagttggcaggcagagctccgcccccgcctcgcctgccgcgagcgccgccggcctggccgggcaagctgccaaaagcctattgaacaagaagtcggatggcggtgtcaaggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaa

SEQ ID NO: 3017 - DNA, 1224 bp, Homo sapiens
  ENST00000441192
gtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaag

SEQ ID NO: 3018 - DNA, 2629 bp, Homo sapiens
  ENST00000472912
cccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggatgataccctctttttaatctttccttccccgaccttcaactgttcctgctgagagaagggcagggtctctctgctcccttctgccctggttctcttggccgggaccgcagggctgtctgagatgcagcaggggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagttggcaggcagagctccgcccccgcctcgcctgccgcgagcgccgccggcctggccgggcaagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccattacgtctgtgctggaggatgcctttgtctgctgcttttcctcccaccatctatccttgcagagtttctaagcacaaccctcttcgcccgtggggccccagtcaggtcatccagatgggtctggtggggttggagagggtgtgtgtgttgtgggtgcacacctgcctgctgcttttggaagccgatcgaactccttgcttcccttaacctgctgcttgctcacctggagctgtggcctagcggggctgacggctgtggggccccctcctggatgtgcctttggctgcgctgccctgtcccaactgtgctgcttggctgtgctggcccggctgggccgtggtggtgctgttctaacgcttgcagttgtcttgcagccttttgctcctgtgaggaaagggttgtggcctggccccgcccagggctcgggttaggatgagcccaagctcaacccaagctctcccttaccctggtggcagcccctgctggtagtggcattccctataagagaagcccatgccggcaggacatcaccagctgtcccttggctttggatgggttggggaggaggcctctggagggcaccacctctgcctgcctgtcagtctgagccctgtctggttttcctgaggaacacgtcctggcaatgagagctggtgtgaaatgtgcagctttcccaagcctcgagagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgag

SEQ ID NO: 3019 - DNA, 512 bp, Homo sapiens
  ENST00000474131
ggtgccatcctcacgaccatgcttgtctccaggaacttctcagctgccaaaagcctattgaacaagaagtcggatggcggtgtcaagccacagagcaacaacaaaaacagtctcgagccacaaaccactgtggtacacaacgctacagatgggatcaagggctccacagagagctgcaacaccaccacagaagatgaggacctcaaagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaaccca

SEQ ID NO: 3020 - DNA, 1555 bp, Homo sapiens
  ENST00000477205
ataactaatggctgggcttcaggagaaagtggtcattgtctctgcagactgcagagagggagacgggagggaaggtgtgttcgctcttcctgccaagggccctagagacagagaagagggatgtctttgtcataagcgatcacaggggactcctgaggactggggagggctctctgtaacttgggaggttccccagtaggtaaattgatggatttttctcccccacagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatcgtgagtgggttcgtgctgctgatatactcctgcctgcccctttacccctttgtctctgtctcctgctcaccttctcatcccagttgcccacttttcccttatttgaccttcgtgctgcactcctactctgtatgcttgtccccttgtgccccgatggttgtagacaggcacctttgaaggccctgctcctgagctccaagtgccattcattctgcagctgctttgtggcagtgccagtcaccacaatcaagctcacttatttcttgccgggcgcggtggcttacgcctgtaatcccaacactttgggaggctgaggctggcggatcacgaggtcaggagatcgaggccatcctggctaacacggtgaaaccccatctctactaaaaatacaaaaaattagccgggcgtggtggcggtgcctgtagtcccagctactcgggtggctgaggcaggagaatgatgtgaacctgggaggcagagcttgcagtgagccaagatcaggccactgcactccagcctgggcaacagagcaagactccatctcaaaaaaaaagaaaaaattatttaagcctcacctctttccaagacggattggaaggaaaccctttgagattaggttgagatgatctcagcacataagaactaagctctgtgtctgcaggtttcacaatagaggaaattaaaaccaggataagaatgtgcaaaccagggcactgttggtgatttgcgagatcggaagttgtggctagaatcttcctgactatggaggaaggcagacgtcttgtatagggggtggggtgtacattctggacagttcatggaaaataaggggataagaagctgaatcatcaccccctcccatctttctctctgctctatgagaccctccccttccttatttttatctcttcccactttatgctgggccttccctatcctgccctgagttatagttagtcactaacttctccgctggctcccacccttatcacatctcagctacatatataaactctctgttatctaagtaattctattagccagaagcaattccagagtttatattagtactaggaaggtgtcatgtagcccctgtctaacatttgaattgaactaaaatgtgaatctcaataaaagcaacacagttttcacagca

SEQ ID NO: 3021 - DNA, 773 bp, Homo sapiens
  ENST00000492020
gcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaaggtaagtgtctccagcctctgaacagactggcctctttctccccgcagtcactatgggaattcttggcacctggttccccctttcccagggaatcttcctatccttgctagtctgctttaaaccagatgcctttgtgctcagaacagaaggttctgctggcctgagagggaagtagggaggtatttttcctggccctagctggatgggaatgactcaggggaagtgatccaaatcatagtttataccagagctgaatccggaacctgacttctacacggatgcttcatctccagggcttgactctgggttttttaggtcatttggttatctttctttttttcctttttagagcacaaatccttttaatcaaatgaaagccaaatttgcctgagtgattcaggcagggtatagggcttggaacctgaaaccactctccttttggtctttttccttc

SEQ ID NO: 3022 - DNA, 747 bp, Homo sapiens
  ENST00000477652
ttggattgggtctctcctccacgttggttgtggtttaatgtcttaaaagtggctcttacctcctggacactcctctccaggattctcagggttgggtctctgtgtcattggtctcattactcttcaacttcagtagtagctctgtccttcctgggcagcgatattttagtgtttatgttggtctcaaagctgtgacttttgggtgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgt

SEQ ID NO: 3023 - DNA, 3767 bp, Homo sapiens
  ENST00000394762
ctccccggtaaagtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagttggcaggcagagctccgcccccgcctcgcctgccgcgagcgccgccggcctggccgggcaagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 3024 - DNA, 3818 bp, Homo sapiens
  ENST00000322680
ctccccggtaaagtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 3025 - DNA, 3824 bp, Homo sapiens
  ENST00000423381
ctccccggtaaagtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagaaaaggaagtcgagttccagcgtgcacctaatgccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaaggtagggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 3026 - DNA, 557 bp, Homo sapiens
  ENST00000508074
agtgccaccagcagcgacgacagcatttattccaactgaagacttcactcaaaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgca

SEQ ID NO: 3027 - DNA, 1640 bp, Homo sapiens
  ENST00000512453
cccggacccaggtgctgccagggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcgcgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaac

SEQ ID NO: 3028 - DNA, 12240 bp, Homo sapiens
  ENST00000282356
aagctccagcatccggagccgccctagccggcaccgcggcagccacagcctgggagagagaaaggaaagagggagggcggcgggaaaggctcggcgcgggaggagggcgggtgaggagggaaggagcgagggggagggagcctctctcctcagcggtgcagctagtctccctccagcgggcggcgactccgggttccccctcgcgccctctcgcagaggctcgcccccttccccgcccaccgtccctgcgagcgcgggcggcggcggtgggcgtgtgcgcgcgtgaaggacgccgcctctctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcgcgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaacatacatatataccagttggtaattctaacttcaatgcatgtgactgctttatgaaaataatagtgtcttctatggcatgtaatggatacctaataccgatgagttaaatcttgcaagttaacacaacgtaacacttaaaagcatacattttcagcaaccagtggcacatatttgaagtgaatagtagcaaattgtttttgctttgaaaatctagccatcctacatcctttggatttcttcacaaggcagtaattcctttgaactactgcttagctaatactaggtagtgctaaaagacatgttcccataacttttacaacattttactttttatcattgatgtgttcaaactgtttacaaggagatgcttatagatgatagttgtacatatgtgcaaaaaaaaatccacttgcaatggtaagaaattgaagtatccttaaaggccatgaagccatatgtccctaaagcctgtgtggagaatgctttattttattcttatttatatacactatattaataataaccaaaatgttctaagattctgccattttacaaccctggaggaagtaatttacaaactcacgctgagttccattctttccttcacctgctctccaataagatgactttctgatagacaaagcttagggtgtaataaacagggaagaaaagaaggtaagactgtacttaaactgatgaagataagattgattccttttcattttccagataaaattgtatttactcatgaatttatacaactttacagataagaacattttaatggataaactctataattaccaagttgcaaatatttagaaaattctatttcacaggttagtgccaaaatgtcttcatagagtaggaataatattccattttaagattattcattattgactttaatagagtaagaaaacattattgtttatcaaagctctttttttatccaattgatggttatctacacatatcacttataaactaaagttatttatgaaaagctagtatgtctttttctcgtatttggaatgaaagtacccacattttacaatgtagtgttgagaatgtggctgccaataaatttagcacaatgcaatttatttaccttaaaaaacaaacaaaaacaaaaataaagaaaaatactgatttcaaatcagactcttaaaaagctggaacattagacctgatattttattatgatttttcccagaataagtttaatttctctttgactttcatagaaacactttccccttatagaaattgcactatctccaatttatttctagtttgagttgaaatgaatattttatcagattaattatgtgtcacatttttggtgggttttctcaattttaaaaaagaattcattttaaaaaataattattttcagagaccaaataaagacaataaaaatgactatcacataaaaatccttgttaaaaaagagatcttaaattatgttggctctccctcaaaactattaaattagaaaacgaaactaaagctccagtttgtagaggctgttggacctcagtagacattcttcttttcaatcacaaatctctctctactactgttctcatgggaagaaaacaaggtaggacttcttatctttcatagtttaagaatctgacaggtcactgatatggagcccctgaagaagcacatcatctgggctcagaagattattttttgttttgttttatttgtactatctagtagagagcacttttcttattccctctttccttccttcctcatttaattattccctctcagaattcccatgttgtccattataaggggctcgctatttttaacctttaagaatgtcttctttgttaagcattaagatttccatttaagaggatcaatttcctgttgtactttttaccatgagactgaaacacacacacacacacacacacacacacacacacacacacacgtgttggaagagcaaagagagggaagggggtctttttagaaagtggcacttggcgcttagctgaaagatcagaacacatcattcctccctgcccacccccatattgttccaagggcagttgttacattatttcaacactagagtagggcggactgcattgtttggccctgagaactatagaaacaacgttgcaaataccatgcccaatgtgtattttagaatttactcatttaaatgagtgcatattaccattcctccatgtgagtactcgagttgataattccctctatctttttaaacccataaactacatttttaaaaaaatcaatgggagttttaaattttgactcatgttaaagataagattctgataatgactatatagtgactaatttcattgtttcagtaggaaacaaatcaaactttcaaaaatgttggtcatttcagtcaaattattcaaagatttcatatacatacatcctaagttaggataattatgttaacatttttgaaagaacagccaatgtttatattgcttgttaaaatggaatgtattgtctatctcaaagattacttagctaaataatagtagacaaatggagatttaatttcacaaaatacttcataacatcactcctaattggcaatatagtcacaaagcaaaagaattcaaatttcagcaaacaataaattacattttacattttagagctaacacttatcacattacattatgggtttttattttgagataagttcagctacatagcataaactaggtttttttttataaccatgaaggacagtcttgaattatttcccccattaacaaagtctaattggaatccagtattttttctcaaactgtaatttcacttgtcccaggacacataaataggtaaaaattagaataatatcgtggtagaagttaattgtccagaacaagtgcattatataaatataatgcaagcacatgtcatttaagattttctattagtcacattttaagaaaaatagatgaaagtatagtatttttaatccaattcatccaaattattctatcgatatatagtcaatattaaaatttaatgtgatattttgaattctttatttttatactgttttcaaaatcaagagtgtatgttaggcctttgggacatcaagtgctcaatagtcacatgtggctagtggctaccatattagacagcactagtctagagtactttttattttaagcaaagtgacacttgaagttctatgcttagatttaagtggcctcagttttcacattgaggagctggtgggaggccacaaagaaagtgtttcagaaatgttacacactgagtaaaagcttattgaccactcctgcccattcatttacttcagaggagaaatgattcctaacatgacttcaaagaacgggcattactaaattatctactgaccaatccctctgattcctgatgggccctggagtcttgactacagcctagagtctcctgagtactgccatgatgccaatagcattcttgcttaccaaaatctactctcagccaactatgtgtcttcattcaggaagaactgcacatagaatctgattttgaggcctggattaagcttcatgccatccttgtatcacaggcaatatgtctttctggaaatctaatgaaccataccaaatctgcatgatgaagattgtgtaatgatggtgatatcatgccagttatcctcaaagtgggaatatgaccattagctggcattttttaagatttccttagaagggtttaatcaacactgccattacacatggatttaacaaaagacttttgaaaattttttacatactgattttagaataatcctcaaggttctatagtcatttttagtggaagacttaaaaagaaaggaacaatttttactgtgacttcaatttcatagtattttaaacatattttgtaattcagaatgtttagcaatccctatgtcctgtttcacatgcatggtaactgatggtgggttgcctacaggctgaagatttggagagagccattttgtttcataaatcagtttttattgcacagaagcagctggttgtatttcaagttggaaaaagaaaagtaaatgccagaaaaggcaaaggataaacttagtaagccatttattttgttttagaattgtttttgcaaagcaaatttttttaaaaaaaggtcaacaaagtgaatcagcactagcattttcttgatggttgactcaatgtataattaacaaatatacatagcagagtcaattaatcatagtgccattatgtcacttatttgtcattgcaaagtattcagtcatgttgtctagatttactttagatggtgcaaaatttccagatagtaacctatgtaaaaggatttgtaatttccttgtaattcctgcctattagtccatattctgatttccttatgttcatcactgatatgttcctgatcagggtcattgctagtagttgagcatttactggttgaacattgtttaatggttagatgttatgtgtgtctgcatttaaaaaaattgtgtacatgttatttcactattggtattacaatattcataaccacatgataaacagaaatgtacccaataatttcctataaaatttttcaaagtccttttattcccctgacacactcagggtgaatttttgtctccttggcaaataagaaaaaaaaggagagagaccactggagagatatcagcaaaccacccacagtaaccaagttcagtatttcctctttctatattttgaccaatatattaagagcaaattttgtcattattactccttgtggctattacctgagatcagataatataatctcagctcataaagcttggccatgtctatacttatcttggagagcaataacaaacttgattaatttgtttggttatttaaaattccaactttcataaatgctctgtgatgtactcaagacgattgggttgtgtgatactaacttccttcaagaactcagtctgttccctgttgtctggttcagaggtccaccagggcaaaatagaagccttgccgagaaagtgaactgtcttactccttcaaaggaatcagatgttgctctagagaagactccaggcatctacctggttgagctcaaatgaggcaagtgggagaaaacctcttctcatcctctgattgaaagtgatacaatttgaatattggtatattgtcattggtcagtaatggaaaaatgagattccaccagtgggttactcttttcttgtcttggtttgctatgccttatcccagatcagtgttttgttccatccctatggtcatctctaaagccctgacaggagcatcccagactggagaaatgcagcgtatctgtggcccagaattttgtttgatactctaaacagcaatgcaaagactgcaaaatcacactattctaaacagttgttttcagctcattttgaagattgacctggaaaacatatagatacagaatatatacatttaatcgttgcttgtgattcattgtgtcaaaataacatttaattttcactctgattaatctttattttccatttaaaagattatttcaggctacttaaatacaagaccttgcattctaatttttgaaagcggttgttttccctgagctctctctcaactttgacagtttgtgaatgataaaaagttactaggtttgtcctttccttgatagatgtagagcagttcatctgttttgtaaaggtacagttaagcataactataggctgggcgtgatagttcatgcctgtaatcccaacactttgggaggccgaggttggcagatcacctgaggtcaggagtttgagaccagcctggccaacgtggtgaaacccctaatacaaaaattagctgggcatggtggcacgctcctgtaatctcagctactcaggaggctgaggcaggagaatctcttgaacccgggaggcagaggttgcagtgagccaagatcatgccactgcactccagcctggacaacaagagcgaaactccgtcaaaaaaaaatatatatatatgaccataaattgaaaactatcatctcatactgcctccttttaacctgacctattttatatacctacaatacagttaatatgcagcagcgtagagaacaaatagcatattcataatttgtaattttgtttttctttttacggcacccttaagtctcagtaatattttaaaagtcctctataagccaaaagaacgttgtaacatatccatttattaaggagttaggcctaaacatagtaatagtagtccattccatgtccaacagatgttgctgtgtttctttcaacatttttcaatgtcttgtgagtttagtgagtgggtacagctgagttggggtttaggtgatttcttatgcccaatgaactaaaggtatcagtaaaagattattagtaaacaaattagttatttatgctcttacttgaatgtcagtcattcattttatctctcgtctttgagatacacacattaaaacttatgtgcatatttttttaaagagtaatttccacataattccccaagaactgaactcaaatctccaaaaatttttcagaactcaagcaaccaatgattcacagagcaaatctaccaaagccccatttttattggaacacaggcatgctcatttatgtacatattgtttgtggctgcttttatgttgtcaaggcagagttgagtactttcaacagagaccatatggactgcaaagcctaaaatgtgtatctggacccttacagtaaaacaatgaccctgggttttcatggcaccccaatgcctttttggtgacttgcaggaatacagattcctatattccagtttgtttttttttttttctccttagcttaaggttcgtattcccatttgcttctgagaaagttaggaaaattttgttttatgttgcagatgctctcacaacaataattgtgctggagatagatacaacttagtgaaattttcctacagaactaaaaacgcaaaattgcatcactcctgaagaaaagaaatttagagtatgaattgagttggttgagagtagaattaaaaagatttctagcactttgagcatgttttagaaatttgatccttacatttaaaattatgtaaatgacatctttcactggcatttgctcacatttaagtcaatctacagctgttacttactaagctaagaaataagaagatccctatggttctgaatctctcataatattctgaagtaatttatatcaattgaattttcattaatcattttaggaaatattatgttttattttgtggcattatatgacaatgactttctcaacaatagctcagggaatacgcaaacagccagctcttttatgtaagaaagccattttctaatccccacgctttcctgagtgttacgtattttatttctttgaaaagagagggccttgagtaaatgctttcgtttgctttccttacatatttagaaatccaagaagggcccttgtcttagtctatttctgtcacagagaaattgttcattccaaaatatccaccttaagggaagctagtgaccgagatatggagaaaaacataggcattcatgacctttgtgtttccgtttgactttcaacatctgtaaccaaaaggtcacaaatgaaatatttagtagaaagtgcaatatcaatttattaggagtacctaaaattataactctaaataatatacagcaatattattgctctattattacagcaatcaataatataatatagccactaggatacactcgctgtagaactcagaacaaaagatatcaatcttctgccagtccgcatcattatgtgtagcagagactttactggaatgagtgaggggaaagataacaaaatgtagattaggattccacattctcccctgcccatcttcttgattgctcagtttgaagacgatcattgatggacaaatactttagaaatgaatgaagtcaatagctaatgtttctcccagaaactaaacaacatagtttaggggatattaggcctacattctaatcacattgtaaggaagtgattttctaattttgaagcttcccaggagcagccccctccaggaacaattttccctgtgaactttcactgagaaactattatatgccatggaggagtcaaagatgaattaaatccaatgctatcctccaggagtgagctttgtagttggagagaaaagccaaccttatagatacaacctgtacatatataacctatgctgcatttaggcagatgataagccctaggaatggaaagagggaaaagctcccttttgccaggaatgatgaaggaaagctttatggaaacacaggctgtatgtgaaagatgggtgaatctttgcaggtagggaagaagtagggggcatgtctggctgagaaccggcctgatcatagagtggaaaaatgaaaggcagaggtgaaggaagaatactaaatgtgaaaggctgaaatacacagggaagtgttgccagtgtgcaacagaatctcatctcgtgcaaaattgaattagacttccttactccttccttactctgggtaggtccatgtgcagcctttcctcagagcatctagcctgacatacttggctcatctgctgtgcttctaagccaaataaaaatcatcaaacacatcgaagatatttttgggagtcaccaggttaaagcaaagcctcagtcactgaaagcaaaaactgaattggccaggtctccactgacaaaacagagtaaatgatagtatgacagataatttcaagttttccaagactccaatttctgaaaaatgtctcatgactccaaaaaatcacgtacttcctaaaatgttgccagtggaggaccgaatcaaggttattgctgacctcattttttcaaccttttcagttatttgacctgaataggcaatcccccaggatttctgattgaattctacctgaaagtttagattttaaaagacaacctgtaggaagctaagtctcaggcaacaaaatttaaaaccatcagaacttgtttctccaaacatcaacctgctcctgtcaagtcctttttcatctctcccttttgtccctttacatactgttttgtaagttccttttgatatcatttattgcaggcagtatttttacatccatcttcaagaaacttgggagacatttagacatttagtatgtgtacttttagttgtcttgcctctttatttcagataatgcctgtgattagtgaatggcggcattattcctgaagacaaatgaaggaagatagggagcaagattgactgtcatttgaatgatggaagagaagtagaattactgtgaggttacaaaaatcgtaagttagcagacattgagaaaggaaaacttcctacttgggcttttcaggcttatgtgacattatctggatgtgttttctagtctttcctaaaggagaaatttttattcctgggttgctgaaagctttctggactaaaaggatataagcagctcaatagcagcatagaggattagattaatggaacagcactgcatacaggaaagctacatctccaatagtttaggctgcaagtcagtagccaaacacaagagcatgtaagatttggaggacaaagtataaatattttaagtttacacaaccaagattataggctaccttcccaacttctaatttgaagagcactgaaaatggagctgtgaacacttcatttttaaaacctgacaatatggtgctattgactacttaatacaaagatatattacaatatttttaggtaaatgtattaagtctggcctgggcataaatgtacatacagaaaatgtttgtagagaattcatcaaaatcatgcccatttgctgttgtagagctacagtattcttcaatggtggtgactgaccagtgagtttctacttcttacagatgggacacaacagtcatgggctgtctcagctgcccaaagcctgaggcagaccacatgagagctgtggcttcttcttggattcaggttggataacccaattcagtaattaaatatgtaaattttggggggggttggggggtgttttctaggaacttgaagagtacgtgacattataaaaaatgggtgttggaagactaattgtagaaatttgacctgagggccaatgttacttggtgtaagttcactcagacagacatgtcagaacatgcccaaagaagcctatatcttgctgctgggaaatgtaaagcagttggcatgtagaatacgataataaatcatttaagaaaccaccaaaa

SEQ ID NO: 3029 - DNA, 571 bp, Homo sapiens
  ENST00000504544
ctctctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaacccca

SEQ ID NO: 3030 - DNA, 1678 bp, Homo sapiens
  ENST00000515231
ctctctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcgcgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaacatacatatataccagttggtaattctaacttcaatgcatgtgactgctttatgaaaataatagtgtcttctatggcatgtaatggatacctaataccgatgagttaaatcttgcaagttaacacaacgtaacacttaaaagcatacattttcagcaaccagtggcacatatttgaagtgaa

SEQ ID NO: 3031 - DNA, 599 bp, Homo sapiens
  ENST00000509408
ctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgctgttacaggaatattccaagatacatagaacctcaagatgttg

SEQ ID NO: 3032 - DNA, 852 bp, Homo sapiens
  ENST00000514007
ggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattgattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaa

SEQ ID NO: 3033 - DNA, 548 bp, Homo sapiens
  ENST00000504090
tccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacacacaccatatccaatgcttgctgctgccctcacctctaaaccgtcacccaccctgtgcagtgatcctttccattctcttctttgttgagcctaaactcacactgaaaaatctgggaaaagagcatctgagacagagtactatcaagtgccaagtgaaaggacccaacagtggagactatcctggcttcctggaagatgagcagtgagccggtgtaaaagaagaggaagaatactaggagagttcagcacaatggacagggccaaggcattattagtatatactagtgg

SEQ ID NO: 3034 - DNA, 563 bp, Homo sapiens
  ENST00000502916
atagatgccatgaaggccctgatagagacaaaggcaaaaaagaattcaatcaggaatgattttggtccagatttgggactaaaactagatgtttctccttatttacctgataaaggatgattaagcctttattgacacaggcacagagaagcggagtgctgcttgtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattctt

SEQ ID NO: 3035 - DNA, 788 bp, Homo sapiens
  ENST00000505763
gagacaaaggcaaaaaagaattcaatcaggaatgattttggtccagatttgggactaaaactagatgtttctccttatttacctgataaaggatgattaagcctttattgacacaggcacagagaagcggagtgctgcttgtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgttctttccatggcctggcctagcctcactaagacaaggacttcaggtgagattttcctagaagagttctccagtccctgcagatggaccacaactacgttgagctcttcacatcttcccgcctcatcgcccagagtgggctgaaggcattgcaatcagaaagaacaaaagcttttgacccatactagcataaaacctgctctgtttttcttgatggtcaaattaatttggcaacaacttgaaagccaataaagtttgtaaaaa

SEQ ID NO: 3036 - DNA, 2560 bp, Homo sapiens
  ENST00000509645
cacaggcaatttatatatttgtctatatctagggtcacaaaagtggcgagtggcataaccagggcttgaacacacttcctgactcccaatagtctctgcctcatatcaggtcacccctactaagcccaggactgtggattattttatttgctgaccttcctgggaatttattgactgcccatcctcacaagcaggggtaaacctccaagaatgggctgccattgattggattccattctttaggcaaatcatgccctcaagccactgacttcttggattataaaatgatttttaaactctgggcttagtccttcaagtaccctcaaggggttagaaagaactataaaccccaagatagaaacataaggtagtattccataagttctgggatactctcccttttgtttgccatttaatccccacagaaagaatgatgatgcatgaatgattccattctgttaccatagagatgtactttaagttctgaattctaggtgattgtgaagcgcagcccagaattattttgctggttctgccttcaaagaacttccagtccacaggcaagtgaggagctgtttcttgacttctgttggaaagccgtctgccactttgggggtctcaggtggtacatggccctgtcttctcatactccctcagctactgctacctgaagctgtgcctacctacagtggcccctgaggacttaaacaatttttttctcacatatatttagtggtactgctgggaaatggaataagatctggaagtttgtaagctgagggcaagcccaggtcatcctaaaaacctcgctaagtttatggttctttattatttcaggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcgcgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaacatacatatataccagttggtaattctaacttcaatgcatgtgactgctttatgaaaataatagtgtcttctatggcatgtaatggatacctaataccgatgagttaaatcttgcaagttaacacaacgtaacacttaaaagcatacattttcagcaaccagtggcacatatttgaagtgaatagtagcaaattgtttttgctttgaaaatctagccatcctacatcctttggatttcttcacaaggcagtaattcctttgaactactgcttagctaatactaggtagtgctaaaagacatgttcccataacttttacaacattttactttttatcattgatgtgttcaaactgtttacaaggagatgcttatagatgatagttgtacatatgtgcaaaaaaaaatccacttgcaatggtaagaaattgaagtatccttaaaggccatgaagccatatgtccctaaagcctgtgtggagaatgctttattttattcttatttatatacactatattaataataaccaaaatgttctaagattctgccattttacaaccctggaggaagtaatttacaaactcacgctgagttccattctttccttcacctgctctccaataagatgactttctgatagacaaagcttagggtgtaataaacagggaagaaaagaaggtaagactgtacttaaactgatgaagataagattgattccttttcattttccagataaaattgtatttactcatgaatttatacaactttacagataagaacattttaatggataaactctataattaccaagttgcaaatatttagaaaattctatttcacaggttagtgccaaaatgtcttcatagagtaggaataatattccattttaagattattcattattgactttaatagagtaagaaaacattattgtttatcaaagctctttttttatccaattgatggttatctacacatatcacttataaactaaagttatttatgaaaagcta

SEQ ID NO: 3037 - DNA, 782 bp, Homo sapiens
  ENST00000510858
agcgcagcccagaattattttgctggttctgccttcaaagaacttccagtccacaggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcgcgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaacatacatatatacc

SEQ ID NO: 3038 - DNA, 803 bp, Homo sapiens
  ENST00000512890
aaagaacttccagtccacaggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcgcgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaagaggtccaccagggcaaaatagaagccttgccgagaaagtgaactgtcttactccttcaaaggaatcagatgttgctctagagaagactccaggcatctacctggttgagctcaaatgaggcaa

SEQ ID NO: 3039 - DNA, 4453 bp, Homo sapiens
  ENST00000392474
gcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggtgccaag

SEQ ID NO: 3040 - DNA, 5218 bp, Homo sapiens
  ENST00000347034
cccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggt

SEQ ID NO: 3041 - DNA, 5175 bp, Homo sapiens
  ENST00000538733
cccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggt

SEQ ID NO: 3042 - DNA, 5304 bp, Homo sapiens
  ENST00000337174
cccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggt

SEQ ID NO: 3043 - DNA, 5598 bp, Homo sapiens
  ENST00000324774
gagcctggggaggtcgagggtgcagcgagccgtgatcgtgctactgcactccagcctgggcaacacagagagaccctgtctcaaaacaaacaaacaaacaaacaaacaaacaaacaaaaaaaacaaagaaaaaaaaatgggagtgggccgggcgcggtgactcacacctgtaatcccagcactttcggaggccaaggcgggtggatcacgaggtcaggaattcaagattagcctggacaacatggtgaaaccccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggt

SEQ ID NO: 3044 - DNA, 3797 bp, Homo sapiens
  ENST00000545538
gccattaggatctcacactctgggggttttccctatcttccatcttaactgggaaacacgctgccaaatgcagccctcctgttggcaaacgcagccacgtggatgctgcctcctccctgctcatatctattctctctttttctcccccgccatccgtctcctgcctattccatgtggctgtgccaaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaa

SEQ ID NO: 3045 - DNA, 2006 bp, Homo sapiens
  ENST00000412367
ccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaa

SEQ ID NO: 3046 - DNA, 2116 bp, Homo sapiens
  ENST00000404169
gcgcgcccgccgcccgggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaa

SEQ ID NO: 3047 - DNA, 2051 bp, Homo sapiens
  ENST00000402834
cagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgtttt

SEQ ID NO: 3048 - DNA, 2587 bp, Homo sapiens
  ENST00000446440
cccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaagacctagaaaataagtccccttcctgcctgttgcaaagtaacgtaagagttccctcacccgagtggatgcagaccttcttgctgtcagccacccttccttcatacacatagccagcccaggtgaccagaacctcccaggacagatgaggctttgtgtccttatgagactgggagaacctgctgggcacccctgctgcaggtgctgtggtgggtggggaccccactgcccttcccactgagcacatcatggctacctgacttggtgggagctccaggcagtcacttctgtttcttaaacatagctttactgaggtacaattcacataccatgtaattcacccacgggaagtgtatgattcagtggtttctaatacagacttctgcagccattaccaccgtcaactttacgacattttcatcagcccaagaagacaccctacactccttagctgtccccatccaactcccccaccccagtaaccactcagaataggtatggatttgcctattctggacgtttcgtataaatggcgtcatacacta

SEQ ID NO: 3049 - DNA, 2967 bp, Homo sapiens
  ENST00000392473
gagcctggggaggtcgagggtgcagcgagccgtgatcgtgctactgcactccagcctgggcaacacagagagaccctgtctcaaaacaaacaaacaaacaaacaaacaaacaaacaaaaaaaacaaagaaaaaaaaatgggagtgggccgggcgcggtgactcacacctgtaatcccagcactttcggaggccaaggcgggtggatcacgaggtcaggaattcaagattagcctggacaacatggtgaaaccccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaagacctagaaaataagtccccttcctgcctgttgcaaagtaacgtaagagttccctcacccgagtggatgcagaccttcttgctgtcagccacccttccttcatacacatagccagcccaggtgaccagaacctcccaggacagatgaggctttgtgtccttatgagactgggagaacctgctgggcacccctgctgcaggtgctgtggtgggtggggaccccactgcccttcccactgagcacatcatggctacctgacttggtgggagctccaggcagtcacttctgtttcttaaacatagctttactgaggtacaattcacataccatgtaattcacccacgggaagtgtatgattcagtggtttctaatacagacttctgcagccattaccaccgtcaactttacgacattttcatcagcccaagaagacaccctacactccttagctgtccccatccaactcccccaccccagtaaccactcagaataggtatggatttgcctattctggacgtttcgtataaatggcgtcatacacta

SEQ ID NO: 3050 - DNA, 809 bp, Homo sapiens
  ENST00000535524
gccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggtaagcttgggc

SEQ ID NO: 3051 - DNA, 547 bp, Homo sapiens
  ENST00000542540
attgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggactgtgtgcagctgaatcagtataccctgaaggatgaaattggaaagatcttaacttctggatagtatgtcatgggcatctccctttatccagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggagg

SEQ ID NO: 3052 - DNA, 567 bp, Homo sapiens
  ENST00000539380
attgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagtagagacgcggtttcatcatgttggccaggctggtctcaaactccttaactcaagtgatccgcctgcctcggcctcccaaagtattgggattacagggctcctatggtgtcgtcaagttggcctacaatgaaaatgacaatacctactatgcaatgaaggtgctgtccaaaaagaagctgatccggcaggccggctttccacgt

SEQ ID NO: 3053 - DNA, 563 bp, Homo sapiens
  ENST00000543477
aacgcacacttaaggctccagcaaagtaagtgccaaaaaggggagaatgggaagaatatgctgtatttcacaaaaagcatctaagtagccatctggaaaagccagaatgaacttcaatggtgcatccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtcc

SEQ ID NO: 3054 - DNA, 543 bp, Homo sapiens
  ENST00000544485
gagtcggtggtggcccaaagtccaggccgcatccaccgcccggcgcctagcgcaggggcagcagccgggtcgccacaggaggggccccgggtgttcttgccggcttgggggaactttcccagggtcagcccggaggcgccctgcagccccggcatttggctaaacaaagcaagcgctgccggcgcggcccgcccgagggcgccgcgggaagaacctgggcaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggt

SEQ ID NO: 3055 - DNA, 3157 bp, Homo sapiens
  ENST00000475665
gctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctgggcaagcagggggtggggcaggggcagggggataatggggggcagccttcagggagctgctctgggcagggggaaaatgtgctcatctcaggaagctggtgtggatggtactggacctggctaggcctgatactgaccagcagatgggcgctgtgtttgtagccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcct

SEQ ID NO: 3056 - DNA, 2913 bp, Homo sapiens
  ENST00000296471
atgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctgggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 3057 - DNA, 2905 bp, Homo sapiens
  ENST00000488336
gatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 3058 - DNA, 2818 bp, Homo sapiens
  ENST00000463537
aatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 3059 - DNA, 3314 bp, Homo sapiens
  ENST00000477224
actaatgactggcaagcgatcctatgcagctccaggactcaggctttcccccaactctccactcaccaccccttacattgggcataggaggcctcctccggccccaggctgagggcctaagggagccattgagaaccttggccagggctaagcaggccagtgctcaccagcaccgctgccatcccgcgcgctcctgctctccagtgggattctgcccttaaggctccgccagggtcggggcggggccggttgggaggccccgcccccagcccgcccccggcccggggtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 3060 - DNA, 1589 bp, Homo sapiens
  ENST00000487726
gctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaagggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatga

SEQ ID NO: 3061 - DNA, 1688 bp, Homo sapiens
  ENST00000467248
gatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggagtgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatga

SEQ ID NO: 3062 - DNA, 1475 bp, Homo sapiens
  ENST00000466940
ggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctgaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggca

SEQ ID NO: 3063 - DNA, 589 bp, Homo sapiens
  ENST00000478149
ttgtagccccagaggtggtaggccggcagcggtatggacgccctgtggactgctgggccattggagtcatcatgtacatcctgtgagtggacagatggacaagcaggcttgcagtcagatggggtgggggcatgtgtctgtggcctttctgtgtgacccttcccccatgcaggctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcagg

SEQ ID NO: 3064 - DNA, 1035 bp, Homo sapiens
  ENST00000466535
atgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattg

SEQ ID NO: 3065 - DNA, 1062 bp, Homo sapiens
  ENST00000483811
gcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctgtgagtgtgggtctggggacccaagattccccagcgcccagggctttcacctgtcccaccctctgcagctaaggaaaccccctttctggacccttggcgtcccaggtccctgtgccttgctcagccagctgcctggcgtaggcagctcacccaagtgctcctgccctacccctgattctgcccacgccaggctcaggggctggtgtccctcagggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgca

SEQ ID NO: 3066 - DNA, 561 bp, Homo sapiens
  ENST00000480398
tgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgaccccagaggtggtaggccggcagcggtatggacgccctgtggactgctgggccattggagtcatcatgtacatcct

SEQ ID NO: 3067 - DNA, 1014 bp, Homo sapiens
  ENST00000472895
gcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctgtgagtgtgggtctggggacccaagattccccagcgcccagggctttcacctgtcccaccctctgcagctaaggaaaccccctttctggacccttggcgtcccaggtccctgtgccttgctcagccagctgcctggcgtaggcagctcacccaagtgctcctgccctacccctgattctgcccacgccaggctcaggggctggtgtccctcagggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctgggcaagcagggggtggggcaggggcagggggataatggggggcagccttcagggagctgctctgggcagggggaaaatgtgctcatctcaggaagctggtgtggatggtactggacctggctaggcctgatactgaccagcagatgggcgctgtgtttgtagccccagaggtggtaggccggcagcggtatggacgccctgtggactgctgggccattggag

SEQ ID NO: 3068 - DNA, 513 bp, Homo sapiens
  ENST00000479704
atgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctgggcaagcagggggtggggcaggggcagggggataatggggggcagccttca

SEQ ID NO: 3069 - DNA, 598 bp, Homo sapiens
  ENST00000498324
atgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagacgtgagtgccgggcctgtcagtgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcact

SEQ ID NO: 3070 - DNA, 583 bp, Homo sapiens
  ENST00000476105
atgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagacgtgagtgccgggcctgtcaggcaaggctgggtgggctggtgagcaggggctagggaagtggcagtggagtgcagctgatgctaaggccaggcctgagtgggtgcctgtcggctgcagtgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctgt

SEQ ID NO: 3071 - DNA, 1485 bp, Homo sapiens
  ENST00000620470
atgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctgggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggct

SEQ ID NO: 3072 - DNA, 3316 bp, Homo sapiens
  ENST00000229922
atattgggtctggggacacacatgccgtctcttgattcctaaggatccattacccatttctctgcacagatcttcgggtatccaacctatctgtgcctccttcagccaggagcctccggatctttccagacttctttgcaatactgcctcatgcactgaatccatttctcgcatagcctggcgcttggcaggcaggctggcgttccctggctctgccttccccatctccctgtcttttctcccacggcccatctgcccctcctttcctccacccccttctcctctctgctcccctttatttccactccccacccgcgtggctttgctctccctctcccccctcagctcgtctgtatttggagctccggaagctgccggcgactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttataaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcattttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatgaa

SEQ ID NO: 3073 - DNA, 1430 bp, Homo sapiens
  ENST00000489374
attcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagtt

SEQ ID NO: 3074 - DNA, 1812 bp, Homo sapiens
  ENST00000378990
ggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccataatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagt

SEQ ID NO: 3075 - DNA, 861 bp, Homo sapiens
  ENST00000493172
aaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattct

SEQ ID NO: 3076 - DNA, 1378 bp, Homo sapiens
  ENST00000479291
attgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccataatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaaatgagaagagacggaggcaaagataagtgactttgcaaggggcagctcacggagatccagtgaagggaacatctaatcagtttgatttcgagtccactgtacgggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctga

SEQ ID NO: 3077 - DNA, 1404 bp, Homo sapiens
  ENST00000465994
attgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgc

SEQ ID NO: 3078 - DNA, 891 bp, Homo sapiens
  ENST00000476263
agggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgaggccaacaagttttaggatataatgagtaattgacctgggaaattaaacaaaaataatttcaccgccaaccacagactgtacccataatggaggctggctgtctcacagacttttgctgctggccagagtgaatgactcagcacaagtcaaccccaggagagaaacaatacagagctcacccctggctgattgagggccagaagcgccattcttgtagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtat

SEQ ID NO: 3079 - DNA, 2776 bp, Homo sapiens
  ENST00000616440
tcccctttatttccactccccacccgcgtggctttgctctccctctcccccctcagctcgtctgtatttggagctccggaagctgccggcgactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttataaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcattttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatg

SEQ ID NO: 3080 - DNA, 2686 bp, Homo sapiens
  ENST00000611958
gactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttataaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcattttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatg

SEQ ID NO: 3081 - DNA, 571 bp, Homo sapiens
  ENST00000528396
acccttctctgtccctggacacctgcgcagaaagcctaggagctggttccacccatcactcaccaggttaggtatttcaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcg

SEQ ID NO: 3082 - DNA, 593 bp, Homo sapiens
  ENST00000529133
gacacatgggcgcttccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgctt

SEQ ID NO: 3083 - DNA, 3083 bp, Homo sapiens
  ENST00000533820
gaaagtcgggccgaacggggcagggacttacccaaggtcacgcagcgagcccggtccccctgcgttccccggggagcgctgagccgggacgcggcggtggggtggggaaggggagtggcgcggccctgcggggtgaggctgccgtttgctgagtgtccggcaggggtctgctcgctgccagcccggcccctcctcagagcagctgccgcagcccgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 3084 - DNA, 582 bp, Homo sapiens
  ENST00000527739
gcgctggcccctccccggggactgctctgccttttactaatttgtcctctcgcggaattggcccccggcctgcggagggaggggcggggagacaccgatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgt

SEQ ID NO: 3085 - DNA, 550 bp, Homo sapiens
  ENST00000526966
ctaatttgtcctctcgcggaattggcccccggcctgcggagggaggggcggggagacaccgtgagatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgt

SEQ ID NO: 3086 - DNA, 2792 bp, Homo sapiens
  ENST00000533129
ctctcgcggaattggcccccggcctgcggagggaggggcggggagacaccgtgagtaagagatagtcagagaccgatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctcc

SEQ ID NO: 3087 - DNA, 2960 bp, Homo sapiens
  ENST00000524773
tggcccccggcctgcggagggaggggcggggagacaccgtgagtaagagatagtcagagaccgtgccggagagataagggagagccgagaggaagcggggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtc

SEQ ID NO: 3088 - DNA, 577 bp, Homo sapiens
  ENST00000530442
agagaccgtgccggagagataagggagagccgagaggaagcggggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccaggtgagggctcccctggggaggaggggcagcaggcactgggggagatgcggaaggatgacccacaatacctgcagtt

SEQ ID NO: 3089 - DNA, 3007 bp, Homo sapiens
  ENST00000279247
aaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtg

SEQ ID NO: 3090 - DNA, 341 bp, Homo sapiens
  ENST00000528739
gggaggagcgctcttcctggttgggccctgccctgagctgccaccgggaagccagcctcagggactgcagcgacccccaaacacccctcccccagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatctt

SEQ ID NO: 3091 - DNA, 568 bp, Homo sapiens
  ENST00000532285
cttcctggttgggccctgccctgagctgccaccgggaagccagcctcagggactgcagcgacccccaaacacccctcccccaggtaagaagctgggtagccgagccgggattccttgaccctggccactgctcctgggctgaggggctgccccagcacggtcccttctcgggggcctctgcgttcctggagcaggggtgggggctggcggagcggcacagcccaggcgcctgtcccagcctggctcaccgctgtccccaggggctgggctagggcccaccagctctgatatcgagcctgctgcgggggcctgaggagggggaccccgaccgtctggggttttcagcccacggcaaggggccggtgcaccaggagcttggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccg

SEQ ID NO: 3092 - DNA, 558 bp, Homo sapiens
  ENST00000527189
cttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccg

SEQ ID NO: 3093 - DNA, 584 bp, Homo sapiens
  ENST00000527469
cctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccaggtactcaccgtgcccctcccccacagctgtggcaatttggggagtgg

SEQ ID NO: 3094 - DNA, 581 bp, Homo sapiens
  ENST00000534373
gttgggccctgccctgagctgccaccgggaagccagcctcagggactgcagcgacccccaaacacccctcccccagttccttgtgctgtctggaggctccgccctgccccacctgacctgctggctcactacagagctgcaagcccctgacaatgggatccgggaaaggagaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttcc

SEQ ID NO: 3095 - DNA, 754 bp, Homo sapiens
  ENST00000526954
cacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtg

SEQ ID NO: 3096 - DNA, 496 bp, Homo sapiens
  ENST00000531068
actacagagctgcaagcccctgacaatgggatccgggaaaggagaggtggccggcacgcctgggaactgggaaatccctttcctggattcactgggagcaccgggaggtggctgagaaccctacttctgatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcct

SEQ ID NO: 3097 - DNA, 564 bp, Homo sapiens
  ENST00000527699
actacagagctgcaagcccctgacaatgggatccgggaaaggagaggtggccggcacgcctgggaactgggaaatccctttcctggattcactgggagcaccgggaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccag

SEQ ID NO: 3098 - DNA, 573 bp, Homo sapiens
  ENST00000533909
cctgacaatgggatccgggaaaggagaggtggccggcacgcctgggaactgggaaatccctttcctggattcactgggagcaccgggaggtggctgagaaccctacttctgtgaggggagcagtgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatct
